United States Patent
Diehn et al.

(10) Patent No.: US 10,876,132 B2
(45) Date of Patent: Dec. 29, 2020

(54) INSECTICIDAL COMBINATIONS OF PIP-72 AND METHODS OF USE

(71) Applicants: PIONEER HI-BRED INTERNATIONAL, INC., Johnston, IA (US); E. I. DU PONT DE NEMOURS AND COMPANY, Wilmington, DE (US)

(72) Inventors: Scott Henry Diehn, West Des Moines, IA (US); Xu Hu, Johnston, IA (US); Albert L. Lu, West Des Moines, IA (US); Lu Liu, Palo Alto, CA (US); James Kevin Presnail, St Louis, MO (US); Gary A. Sandahl, West Des Moines, IA (US); Ute Schellenberger, Palo Alto, CA (US); Gusui Wu, Grimes, IA (US)

(73) Assignees: PIONEER HI-BRED INTERNATIONAL, INC.; E I DU PONT DE NEMOURS AND COMPANY, Wilmington, DE (US)

( * ) Notice: Subject to any disclaimer, the term of this patent is extended or adjusted under 35 U.S.C. 154(b) by 0 days.

(21) Appl. No.: 15/556,785

(22) PCT Filed: Mar. 3, 2016

(86) PCT No.: PCT/US2016/020642
§ 371 (c)(1),
(2) Date: Sep. 8, 2017

(87) PCT Pub. No.: WO2016/144688
PCT Pub. Date: Sep. 15, 2016

(65) Prior Publication Data
US 2018/0042242 A1    Feb. 15, 2018

Related U.S. Application Data

(60) Provisional application No. 62/131,564, filed on Mar. 11, 2015, provisional application No. 62/287,272, filed on Jan. 26, 2016.

(51) Int. Cl.
*C12N 15/82* (2006.01)
*C07K 14/21* (2006.01)

(52) U.S. Cl.
CPC .......... *C12N 15/8286* (2013.01); *C07K 14/21* (2013.01); *C12N 2310/11* (2013.01); *Y02A 40/146* (2018.01)

(58) Field of Classification Search
None
See application file for complete search history.

(56) References Cited

U.S. PATENT DOCUMENTS

| | | | |
|---|---|---|---|
| 7,612,194 B2 | 11/2009 | Andersen et al. | |
| 2009/0094717 A1* | 4/2009 | Troukhan | C07K 14/415 800/290 |
| 2011/0054007 A1* | 3/2011 | Broglie | A01N 63/00 514/44 A |
| 2012/0164205 A1 | 6/2012 | Baum et al. | |
| 2014/0007292 A1 | 1/2014 | Cerf et al. | |
| 2015/0257389 A1* | 9/2015 | Hu | C12N 15/8286 514/44 A |
| 2016/0366891 A1 | 12/2016 | Diehn et al. | |
| 2017/0253887 A1 | 9/2017 | Hu et al. | |
| 2018/0111967 A1 | 4/2018 | Liu et al. | |

FOREIGN PATENT DOCUMENTS

| | | | |
|---|---|---|---|
| WO | 2011025860 A1 | | 3/2011 |
| WO | 2014153254 A2 | | 9/2014 |
| WO | WO2014/153254 | * | 9/2014 |
| WO | 2015023846 A2 | | 2/2015 |
| WO | 2015038734 A2 | | 3/2015 |
| WO | 2015130890 A1 | | 9/2015 |
| WO | 2015130893 A1 | | 9/2015 |
| WO | 2015134256 A1 | | 9/2015 |
| WO | 2016043960 A1 | | 3/2016 |
| WO | 2016044092 A1 | | 3/2016 |
| WO | 2019209700 | | 10/2019 |

OTHER PUBLICATIONS

Zanlungo et al. (1995) Curr Genet 27:565-71.*
Supnet & Bezprozvanny (2010) Cell Calcium 47:183-89.*
Crane (2004) Phil Trans Biol Sci 359:735-37.*
Olsen et al. (2005) Trends Plant Sci 10(2):79-87.*
De Maagd et al. (1999) Appl. Environ Microbial 65:4369-4374.*
Tounsi et al. (2003) J. Appl. Microbial. 95:23-28.*
Angsuthanasombat et al. (2001) J Biochem Mol Biol 34:402-407.*
Kubo, N., et al. (2000) Mol Gen Genet 263:733-39.*
Thomas et al. (2001) Plant J 25:417-25.*

(Continued)

*Primary Examiner* — Russell T Boggs

(57) ABSTRACT

Compositions and methods for controlling pests are provided. The methods involve transforming organisms with one or more nucleic acid sequence encoding insecticidal protein(s) and one or more silencing element(s). In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The molecular and breeding stacks find use in controlling, inhibiting growth or killing Lepidopteran, Coleopteran, Dipteran, fungal, Hemipteran and nematode pest populations and for producing compositions with insecticidal activity.

15 Claims, 3 Drawing Sheets

Specification includes a Sequence Listing.

(56) References Cited

OTHER PUBLICATIONS

Klahre et al. (2002) Proc Nat'l Acad Sci 99:11981-86, 11983-84.*
Schellenberger et al. (2016) Science 354(6312):634-37.*
GenBank (2016) KT795291.*
Chen et al., "Characterization of an Insecticidal Toxin and Pathogenicity of Pseudomonas taiwanensis against insects," PLoS Pathogens, (2014), 10(8):1-14.
The International Search Report and Written Opinion of the International Searching Authority for PCT/US2016/020642, dated May 31, 2016.

* cited by examiner

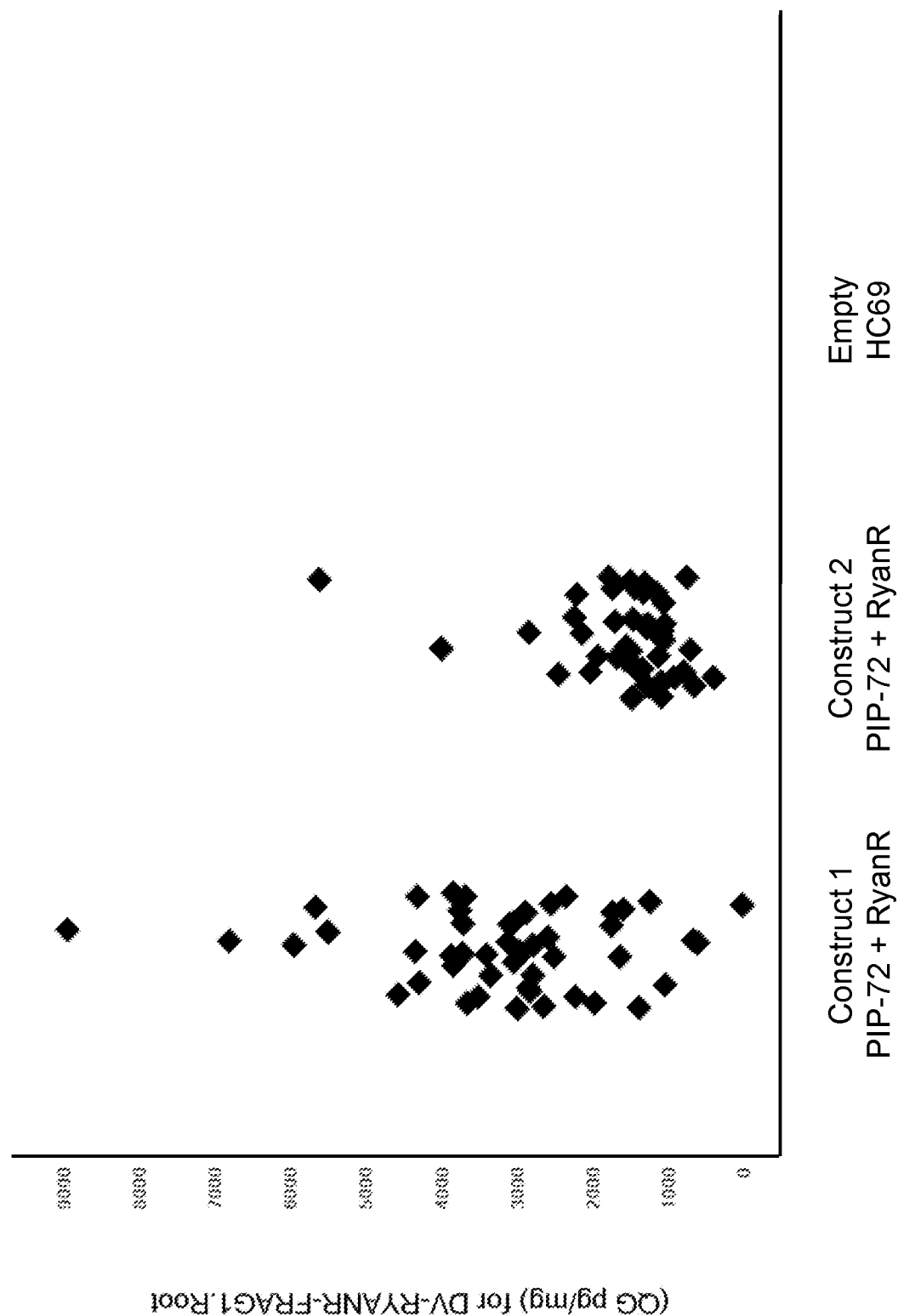

INSECTICIDAL COMBINATIONS OF PIP-72 AND METHODS OF USE

CROSS-REFERENCE TO RELATED APPLICATIONS

This application claims priority to U.S. Provisional Application No. 62/131,564, filed Mar. 11, 2015 and U.S. Provisional Application No. 62/287,272, filed Jan. 26, 2016, which is hereby incorporated herein in its entirety by reference.

REFERENCE TO SEQUENCE LISTING SUBMITTED ELECTRONICALLY

A sequence listing having the file name "6578_sequence_listing.txt" created on Jan. 26, 2016, and having a size of 587 kilobytes is filed in computer readable form concurrently with the specification. The sequence listing is part of the specification and is herein incorporated by reference in its entirety.

FIELD

This disclosure relates to the field of molecular biology. Provided are stacks of PIP-72 polypeptide genes that encode pesticidal proteins and silencing elements. These pesticidal proteins, the RNAi traits, and the nucleic acid sequences that encode them are useful in preparing pesticidal formulations and in the production of transgenic pest-resistant plants.

BACKGROUND

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of Bt. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and the order Coleoptera including but not limited to insect pests that have developed resistance to existing insecticides.

SUMMARY

Compositions and methods for conferring pesticidal activity to bacteria, plants, plant cells, tissues and seeds are provided. Compositions include nucleic acid molecules encoding sequences for pesticidal and insecticidal PIP-72 polypeptides and polynucleotides encoding RNAi silencing elements, vectors comprising those nucleic acid molecules, and host cells comprising the vectors. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues and seeds.

In particular, isolated or recombinant nucleic acid molecules are provided encoding *Pseudomonas* Insecticidal Protein-72 (PIP-72) polypeptides. Additionally, amino acid sequences corresponding to the PIP-72 polypeptides are encompassed. Provided are isolated or recombinant nucleic acid molecules capable of encoding a PIP-72 polypeptide of SEQ ID NO: 849. Nucleic acid sequences that are complementary to a nucleic acid sequence of the embodiments or that hybridize to a sequence of the embodiments are also encompassed. Also provided are isolated or recombinant PIP-72 polypeptides of SEQ ID NO: 849.

Methods are provided for producing the PIP-72 polypeptides and silencing elements, and for using those polypeptides and silencing elements for controlling or killing a Lepidopteran, Coleopteran, nematode, fungi, and/or Dipteran pests. The transgenic plants of the embodiments express one or more of the PIP-72 polypeptides and one or more silencing elements. In various embodiments, the transgenic plant further comprises one or more additional genes for insect resistance, for example, one or more additional genes for controlling Coleopteran, Lepidopteran, Hemipteran or nematode pests. The transgenic plant may further comprise any gene imparting an agronomic trait of interest.

Silencing target polynucleotides or active variants and fragments thereof of US Patent Application Publication No. US2014/0275208 and US2015/0257389 are provided. Silencing elements designed in view of these target polynucleotides of US Patent Application Publication No. US2014/0275208 and US2015/0257389 are provided which, when ingested by the pest, decrease the expression of one or more of the target sequences and thereby controls the pest (i.e., has insecticidal activity). In one embodiment of the invention, one or more nucleic acid molecules encoding PIP-72 polypeptides are provided in a molecular stack or expression cassette with one or more silencing targets or silencing elements set forth in US Patent Application Publication Number US2014/0275208 or US2015/0257389.

The compositions and methods of the embodiments are useful for the production of organisms with enhanced pest

BRIEF DESCRIPTION OF THE FIGURES

FIG. 3 shows a graph representing T0 plant expression of PIP-72 either as a stacked construct comprising a polynucleotide encoding a PIP-72 polypeptide and RyanR silencing element (SEQ ID NO: 993) or negative control line, HC69.

DETAILED DESCRIPTION

Figure 1:
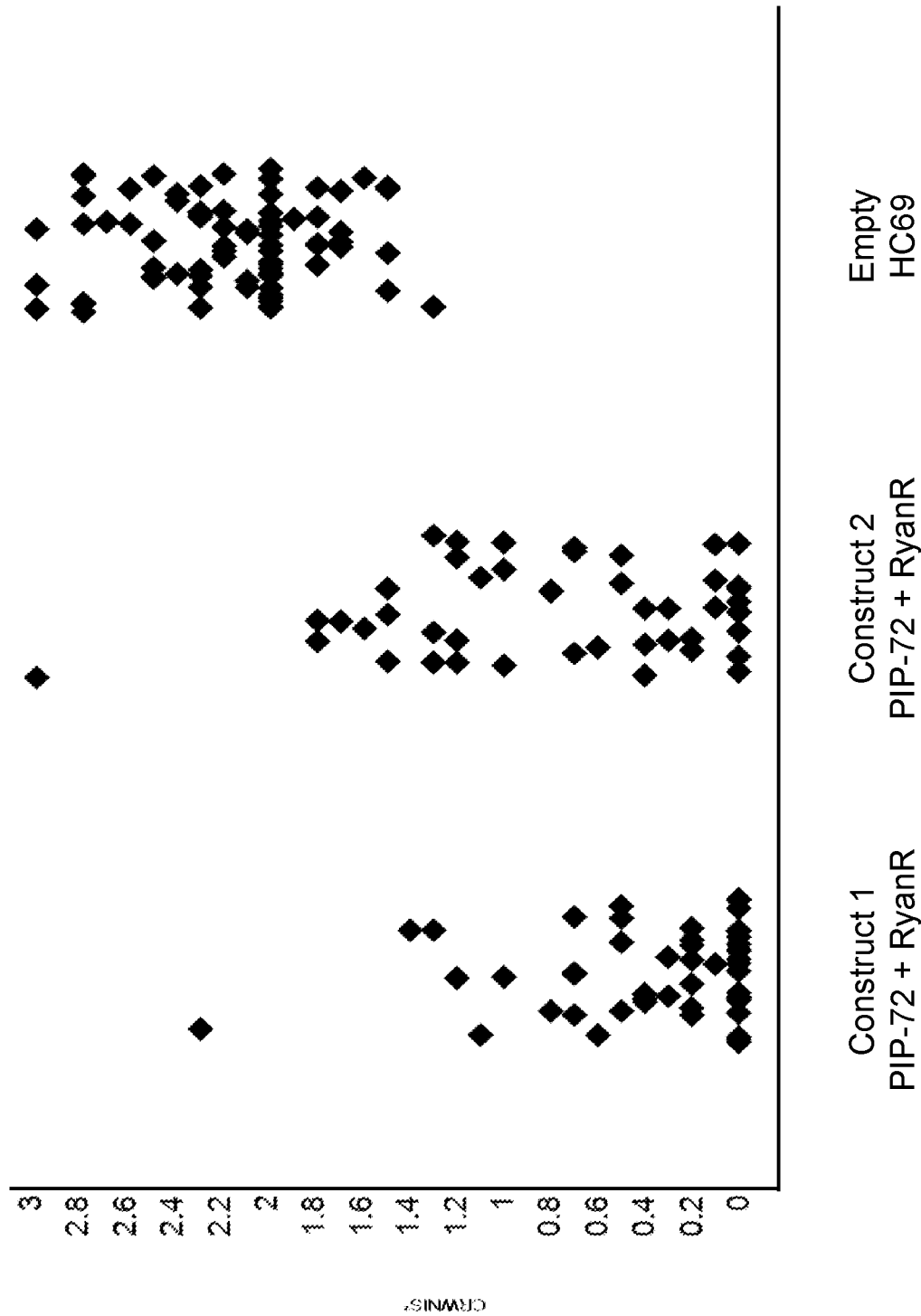
FIG. 1 shows a graph representing the nodal injury score of western corn rootworm feeding on T0 plants expressing either a stacked construct comprising a polynucleotide encoding a PIP-72 polypeptide and RyanR silencing element (SEQ ID NO: 993) or negative control line, HC69.

It is to be understood that this disclosure is not limited to the particular methodology, protocols, cell lines, genera, and reagents described, as such may vary. It is also to be understood that the terminology used herein is for the purpose of describing particular embodiments only, and is not intended to limit the scope of the present disclosure.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with nucleic acid sequences encoding a PIP-72 polypeptide and a silencing element or other pesticidal agent as disclosed herein. In particular, the nucleic acid sequences of the embodiments are useful for preparing plants and microorganisms that possess pesticidal activity. Thus, transformed bacteria, plants, plant cells, plant tissues and seeds are provided. The compositions are pesticidal nucleic acids and proteins of bacterial species. The nucleic acid sequences find use in the construction of expression vectors for subsequent transformation into organisms of interest. The PIP-72 polypeptides find use in controlling or killing Lepidopteran, Coleopteran, Dipteran, fungal, Hemipteran and nematode pest populations and for producing compositions with pesticidal activity. Insect pests of interest include, but are not limited to, Lepidoptera species including but not limited to: diamond-back moth, e.g., *Helicoverpa zea* Boddie; soybean looper, e.g., *Pseudoplusia includens* Walker; and velvet bean caterpillar e.g., *Anticarsia gemmatalis* Hübner and Coleoptera species including but not limited to Western corn rootworm (*Diabrotica virgifera*)—WCRW, Southern corn rootworm (*Diabrotica undecimpunctata howardi*)—SCRW, and Northern corn rootworm (*Diabrotica barberi*)—NCRW.

"Pesticidal protein" is used herein to refer to a toxin that has toxic activity against one or more pests, including, but not limited to, members of the Lepidoptera, Diptera, Hemiptera and Coleoptera orders or the Nematoda phylum or a protein that has homology to such a protein. Pesticidal proteins have been isolated from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin; (2011) PLoS Pathogens 7:1-13); from *Pseudomonas protegens* strain CHA0 and Pf-5 (previously *fluorescens*) (Pechy-Tarr, (2008) *Environmental Microbiology* 10:2368-2386; GenBank Accession No. EU400157); from *Pseudomonas Taiwanensis* (Liu, et al., (2010) *J. Agric. Food Chem.*, 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxicology Journal*, 3:101-118 and Morgan, et al., (2001) *Applied and Envir. Micro.* 67:2062-2069); U.S. Pat. Nos. 6,048,838, and 6,379,946; a PIP-1 polypeptide of U.S. Ser. No. 13/792,861; an AfIP-1A and/or AfIP-1B polypeptides of U.S. Ser. No. 13/800,233; a PHI-4 polypeptides of U.S. Ser. No. 13/839,702; PIP-47 polypeptides of U.S. Ser. No. 61/866,747; the insecticidal proteins of U.S. Ser. No. 61/863,761 and 61/863,763; and δ-endotoxins including but not limited to: the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51, Cry52, Cry 53, Cry 54, Cry55, Cry56, Cry57, Cry58, Cry59. Cry60, Cry61, Cry62, Cry63, Cry64, Cry65, Cry66, Cry67, Cry68, Cry69, Cry70 and Cry71 classes of δ-endotoxin genes and the *B. thuringiensis* cytolytic cyt1 and cyt2 genes. Members of these classes of *B. thuringiensis* insecticidal proteins include, but are not limited to Cry1Aa1 (Accession # AAA22353); Cry1Aa2 (Accession # Accession # AAA22552); Cry1Aa3 (Accession # BAA00257); Cry1Aa4 (Accession # CAA31886); Cry1Aa5 (Accession # BAA04468); Cry1Aa6 (Accession # AAA86265); Cry1Aa7 (Accession # AAD46139); Cry1Aa8 (Accession # I26149); Cry1Aa9 (Accession # BAA77213); Cry1Aa10 (Accession # AAD55382); Cry1Aa11 (Accession # CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession # HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession # AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession # AAA22551); Cry1Ab9 (Accession # CAA38701); Cry1Ab10 (Accession # A29125); Cry1Ab11 (Accession # I12419); Cry1Ab12 (Accession # AAC64003); Cry1Ab13 (Accession # AAN76494); Cry1Ab14 (Accession # AAG16877); Cry1Ab15 (Accession # AA013302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession # ABB72460); Cry1Ab21 (Accession # ABS18384);

Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession # HQ847729); Cry1Ab27 (Accession # JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession # KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession # CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession # AAC44841); Cry1Ac9 (Accession # AAB49768); Cry1Ac10 (Accession # CAA05505); Cry1Ac11 (Accession # CAA10270); Cry1Ac12 (Accession # I12418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession # ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession # FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession # HQ230364); Cry1Ac35 (Accession # JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AAO39719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # AB020894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession # AAQ52387); Cry1Be3 (Accession # ACV96720); Cry1Be4 (Accession # HM070026); Cry1Bf1 (Accession # CAC50778); Cry1Bf2 (Accession # AAQ52380); Cry1Bg1 (Accession # AAO39720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1](Accession # AAF37224); Cry1Ca7 (Accession # AAG50438); Cry1Ca8 (Accession # AAM00264); Cry1Ca9 (Accession # AAL79362); Cry1Ca10 (Accession # AAN16462); Cry1Ca11 (Accession # AAX53094); Cry1Ca12 (Accession # HM070027); Cry1Ca13 (Accession # HQ412621); Cry1Ca14 (Accession # JN651493); Cry1Cb1 (Accession # M97880); Cry1Cb2 (Accession # AAG35409); Cry1Cb3 (Accession # ACD50894); Cry1Cb-like (Accession # AAX63901); Cry1Da1 (Accession # CAA38099); Cry1Da2 (Accession #176415); Cry1Da3 (Accession # HQ439784); Cry1Db1 (Accession # CAA80234); Cry1Db2 (Accession # AAK48937); Cry1Dc1 (Accession # ABK35074); Cry1Ea1 (Accession # CAA37933); Cry1Ea2 (Accession # CAA39609); Cry1Ea3 (Accession # AAA22345); Cry1Ea4 (Accession # AAD04732); Cry1Ea5 (Accession # A15535); Cry1Ea6 (Accession # AAL50330); Cry1Ea7 (Accession # AAW72936); Cry1Ea8 (Accession # ABX11258); Cry1Ea9 (Accession # HQ439785); Cry1Ea10 (Accession # ADR00398); Cry1Ea11 (Accession # JQ652456); Cry1Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1Fb1 (Accession # CAA80235); Cry1Fb2 (Accession # BAA25298); Cry1Fb3 (Accession # AAF21767); Cry1Fb4 (Accession # AAC10641); Cry1Fb5 (Accession # AAO13295); Cry1Fb6 (Accession # ACD50892); Cry1Fb7 (Accession # ACD50893); Cry1Ga1 (Accession # CAA80233); Cry1Ga2 (Accession # CAA70506); Cry1Gb1 (Accession # AAD10291); Cry1Gb2 (Accession # AAO13756); Cry1Gc1 (Accession # AAQ52381); Cry1Ha1 (Accession # CAA80236); Cry1Hb1 (Accession # AAA79694); Cry1Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession # CAA70124); Cry1Ia6 (Accession # AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession # CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession # ADK23801); Cry1Ia19 (Accession # HQ439787); Cry1Ia20 (Accession # JQ228426); Cry1Ia21 (Accession # JQ228424); Cry1Ia22 (Accession # JQ228427); Cry1Ia23 (Accession # JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib2 (Accession # ABW88019); Cry1Ib3 (Accession # ACD75515); Cry1Ib4 (Accession # HM051227); Cry1Ib5 (Accession # HM070028); Cry1Ib6 (Accession # ADK38579); Cry1Ib7 (Accession # JN571740); Cry1Ib8 (Accession # JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession # AAE71691); Cry1Id1 (Accession # AAD44366); Cry1Id2 (Accession # JQ228422); Cry1Ie1 (Accession # AAG43526); Cry1Ie2 (Accession # HM439636); Cry1Ie3 (Accession # KC156647); Cry1Ie4 (Accession # KC156681); Cry1If1 (Accession # AAQ52382); Cry1Ig1 (Accession # KC156701); Cry1I-like (Accession # AAC31094); Cry1I-like (Accession # ABG88859); Cry1Ja1 (Accession # AAA22341); Cry1Ja2

(Accession # HM070030); Cry1Ja3 (Accession # JQ228425); Cry1Jb1 (Accession # AAA98959); Cry1Jc1 (Accession # AAC31092); Cry1Jc2 (Accession # AAQ52372); Cry1Jd1 (Accession # CAC50779); Cry1Ka1 (Accession # AAB00376); Cry1Ka2 (Accession # HQ439783); Cry1La1 (Accession # AAS60191); Cry1La2 (Accession # HM070031); Cry1Ma1 (Accession # FJ884067); Cry1Ma2 (Accession # KC156659); Cry1Na1 (Accession # KC156648); Cry1Nb1 (Accession # KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession # AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AAO13750); Cry2Aa10 (Accession # AAQ04263); Cry2Aa11 (Accession # AAQ52384); Cry2Aa12 (Accession # ABI83671); Cry2Aa13 (Accession # ABL01536); Cry2Aa14 (Accession # ACF04939); Cry2Aa15 (Accession # JN426947); Cry2Ab1 (Accession # AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession # ACG76120); Cry2Ab14 (Accession # ACG76121); Cry2Ab15 (Accession # HM037126); Cry2Ab16 (Accession # GQ866914); Cry2Ab17 (Accession # HQ439789); Cry2Ab18 (Accession # JN135255); Cry2Ab19 (Accession # JN135256); Cry2Ab20 (Accession # JN135257); Cry2Ab21 (Accession # JN135258); Cry2Ab22 (Accession # JN135259); Cry2Ab23 (Accession # JN135260); Cry2Ab24 (Accession # JN135261); Cry2Ab25 (Accession # JN415485); Cry2Ab26 (Accession # JN426946); Cry2Ab27 (Accession # JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession # ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession # CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession # CAM32331); Cry2Ad5 (Accession # CAO78739); Cry2Ae1 (Accession # AAQ52362); Cry2Af1 (Accession # AB030519); Cry2Af2 (Accession # GQ866915); Cry2Ag1 (Accession # ACH91610); Cry2Ah1 (Accession # EU939453); Cry2Ah2 (Accession # ACL80665); Cry2Ah3 (Accession # GU073380); Cry2Ah4 (Accession # KC156702); Cry2Ai1 (Accession # FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession # ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession #115475); Cry3Ca1 (Accession # CAA42469); Cry4Aa1 (Accession # CAA68485); Cry4Aa2 (Accession # BAA00179); Cry4Aa3 (Accession # CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession # FJ403207); Cry5Aa1 (Accession # AAA67694); Cry5Ab1 (Accession # AAA67693); Cry5Ac1 (Accession #134543); Cry5Ad1 (Accession # ABQ82087); Cry5Ba1 (Accession # AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession # HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession # AAA22358); Cry7Aa1 (Accession # AAA22351); Cry7Ab1 (Accession # AAA21120); Cry7Ab2 (Accession # AAA21121); Cry7Ab3 (Accession # ABX24522); Cry7Ab4 (Accession # EU380678); Cry7Ab5 (Accession # ABX79555); Cry7Ab6 (Accession # ACI44005); Cry7Ab7 (Accession # ADB89216); Cry7Ab8 (Accession # GU145299); Cry7Ab9 (Accession # ADD92572); Cry7Ba1 (Accession # ABB70817); Cry7Bb1 (Accession # KC156653); Cry7Ca1 (Accession # ABR67863); Cry7Cb1 (Accession # KC156698); Cry7Da1 (Accession # ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1 (Accession # KC156697); Cry7Ha1 (Accession # KC156651); Cry7Ia1 (Accession # KC156665); Cry7Ja1 (Accession # KC156671); Cry7Ka1 (Accession # KC156680); Cry7Kb1 (Accession # BAM99306); Cry7La1 (Accession # BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession # AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession # HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession #

GU073381); Cry8Ia3 (Accession # HM044664); Cry8Ia4 (Accession # KC156674); Cry8Ib1 (Accession # GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession # HM123758); Cry8Kb2 (Accession # KC156675); Cry8La1 (Accession # GU325771); Cry8Ma1 (Accession # HM044665); Cry8Ma2 (Accession # EEM86551); Cry8Ma3 (Accession # HM210574); Cry8Na1 (Accession # HM640939); Cry8Pa1 (Accession # HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession # KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession # GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession # GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AAO12908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3 (Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1 (Accession # KC156699); Cry9-like (Accession # AAC63366); Cry10Aa1 (Accession # AAA22614); Cry10Aa2 (Accession # E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession # AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession # AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession # CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession # AFM37572); Cry20Aa1 (Accession # AAB93476); Cry20Ba1 (Accession # ACS93601); Cry20Ba2 (Accession # KC156694); Cry20-like (Accession # GQ144333); Cry21Aa1 (Accession # I32932); Cry21Aa2 (Accession # I66477); Cry21Ba1 (Accession # BAC06484); Cry21Ca1 (Accession # JF521577); Cry21Ca2 (Accession # KC156687); Cry21Da1 (Accession # JF521578); Cry22Aa1 (Accession # I34547); Cry22Aa2 (Accession # CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession # AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession # AAG00235); Cry29Aa1 (Accession # CAC80985); Cry30Aa1 (Accession # CAC80986); Cry30Ba1 (Accession # BAD00052); Cry30Ca1 (Accession # BAD67157); Cry30Ca2 (Accession # ACU24781); Cry30Da1 (Accession # EF095955); Cry30Db1 (Accession # BAE80088); Cry30Ea1 (Accession # ACC95445); Cry30Ea2 (Accession # FJ499389); Cry30Fa1 (Accession # ACI22625); Cry30Ga1 (Accession # ACG60020); Cry30Ga2 (Accession # HQ638217); Cry31Aa1 (Accession # BAB11757); Cry31Aa2 (Accession # AAL87458); Cry31Aa3 (Accession # BAE79808); Cry31Aa4 (Accession # BAF32571); Cry31Aa5 (Accession # BAF32572); Cry31Aa6 (Accession # BA144026); Cry31Ab1 (Accession # BAE79809); Cry31Ab2 (Accession # BAF32570); Cry31Ac1 (Accession # BAF34368); Cry31Ac2 (Accession # AB731600); Cry31Ad1 (Accession # BA144022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession # BAB78602); Cry32Cb1 (Accession # KC156708); Cry32Da1 (Accession # BAB78603); Cry32Ea1 (Accession # GU324274); Cry32Ea2 (Accession # KC156686); Cry32Eb1 (Accession # KC156663); Cry32Fa1 (Accession # KC156656); Cry32Ga1 (Accession # KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # KC156689); Cry32Ma1 (Accession # KC156690); Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # KC156707); Cry32Sa1 (Accession # KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession # AAT29030); Cry34Ab1 (Accession # AAG41671); Cry34Ac1 (Accession # AAG50118); Cry34Ac2 (Accession # AAK64562); Cry34Ac3 (Accession # AAT29029); Cry34Ba1 (Accession # AAK64565); Cry34Ba2 (Accession # AAT29033); Cry34Ba3 (Accession # AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession # AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession # AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession # BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession # KC156676);

Cry43Cb1 (Accession # KC156695); Cry43Cc1 (Accession # KC156696); Cry43-like (Accession # BAD15305); Cry44Aa (Accession # BAD08532); Cry45Aa (Accession # BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545); Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession # GU446676); Cry51Aa1 (Accession # AB114444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession # ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession # GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession # ACU24782); Cry60Aa2 (Accession # EA057254); Cry60Aa3 (Accession # EEM99278); Cry60Ba1 (Accession # GU810818); Cry60Ba2 (Accession # EA057253); Cry60Ba3 (Accession # EEM99279); Cry61Aa1 (Accession # HM035087); Cry61Aa2 (Accession # HM132125); Cry61Aa3 (Accession # EEM19308); Cry62Aa1 (Accession # HM054509); Cry63Aa1 (Accession # BAI44028); Cry64Aa1 (Accession # BAJ05397); Cry65Aa1 (Accession # HM461868); Cry65Aa2 (Accession # ZP_04123838); Cry66Aa1 (Accession # HM485581); Cry66Aa2 (Accession # ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession # JN646781); Cry70Ba1 (Accession # ADO51070); Cry70Bb1 (Accession # EEL67276); Cry71Aa1 (Accession # JX025568); Cry72Aa1 (Accession # JX025569); Cyt1Aa (GenBank Accession Number X03182); Cyt1Ab (GenBank Accession Number X98793); Cyt1B (GenBank Accession Number U37196); Cyt2A (GenBank Accession Number Z14147); and Cyt2B (GenBank Accession Number U52043).

Examples of δ-endotoxins also include but are not limited to Cry1A proteins of U.S. Pat. Nos. 5,880,275, 7,858,849 8,530,411, 8,575,433, and 8,686,233; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476,226; Cry1B of U.S. patent application Ser. No. 10/525,318; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families, including but not limited to the Cry9D protein of U.S. Pat. No. 8,802,933 and the Cry9B protein of U.S. Pat. No. 8,802,934; a Cry15 protein of Naimov, et al., (2008) *Applied and Environmental Microbiology,* 74:7145-7151; a Cry22, a Cry34Ab1 protein of U.S. Pat. Nos. 6,127,180, 6,624,145 and 6,340,593; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC807 of US Patent Application Publication Number 2008/0295207; ET29, ET37, TIC809, TIC810, TIC812, TIC127, TIC128 of PCT US 2006/033867; TIC853 toxins of U.S. Pat. No. 8,513,494; TIC3131, TIC 3400, and TIC3407 of US Patent Application Publication Number 2015/0047076; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247 and U.S. Pat. No. 8,759,619; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US Patent Application Publication Number 2010/0005543, AXMI270 of US Patent Application Publication US20140223598, AXMI279 of US Patent Application Publication US20140223599, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database, which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab and Cry6Aa (US20130167269); Cry34Ab/VCry35Ab & Cry3Aa (US20130167268); Cry1Ab & Cry1F (US20140182018); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

One aspect pertains to isolated or recombinant nucleic acid molecules comprising nucleic acid sequences encoding PIP-72 polypeptides and a silencing element. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecule encoding a PIP-72 polypeptide can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments an isolated nucleic acid molecule encoding a PIP-72 polypeptide has one or more change in the nucleic acid sequence compared to the native or genomic nucleic acid sequence. In some embodiments the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments the nucleic acid molecule encoding a PIP-72 polypeptide is a non-genomic sequence Sources of polynucleotides that encode PIP-72 polypeptides include but are not limited to SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 27 and SEQ ID NO: 31, SEQ ID NO: 949, SEQ ID NO: 950, SEQ ID NO: 955, SEQ ID NO: 956, SEQ ID NO: 957, SEQ ID NO: 958, SEQ ID NO: 961, SEQ ID NO: 962, SEQ ID NO: 963, SEQ ID NO: 965, SEQ ID NO: 966, SEQ ID NO: 967, and SEQ ID NO: 968. Examples of PIP-72 polypeptide sequences that can be used to obtain corresponding nucleotide encoding sequences include, but are not limited to, the PIP-72 polypeptide of sequence SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28 and SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941SEQ ID NO: 943, SEQ ID NO: 944, SEQ ID NO: 945 or SEQ ID NO: 946. Nucleic acid molecules that are fragments of these nucleic acid sequences encoding PIP-72 polypeptides and a silencing element are also encompassed by the embodiments. "Fragment" as used herein refers to a portion of the nucleic acid sequence encoding a PIP-72 polypeptide and/or a silencing element. A fragment of a nucleic acid sequence may encode a biologically active portion of a PIP-72 polypeptide or a silencing element or it may be a fragment that can be used as a hybridization probe or PCR primer using methods disclosed below. Nucleic acid molecules that are fragments of a nucleic acid sequence encoding a PIP-72 polypeptide or a silencing element comprise at least about 130, 140, 150, 160, 170, 180, 190, 200, 210, 220, 230, 240, 250 or 260, contiguous nucleotides or up to the number of nucleotides present in a full-length nucleic acid sequence encoding a PIP-72 polypeptide or a silencing element disclosed herein, depending upon the intended use. "Contiguous nucleotides" is used herein to refer to nucleotide residues that are immediately adjacent to one another. Fragments of the nucleic acid sequences of the embodiments will encode protein fragments or silencing elements that retain the biological activity and, hence, retain insecticidal activity. "Retains activity" is used herein to refer to a polypeptide or silencing element having at least about 10%, at least about 30%, at least about 50%, at least about 70%, 80%, 90%, 95% or higher of the insecticidal activity of the full-length polypeptide or nucleic acid sequence. In one embodiment, the insecticidal activity is Lepidoptera activity. In one embodiment, the insecticidal activity is against a Coleopteran species. In one embodiment, the insecticidal activity is against a *Diabrotica* species. In one embodiment, the insecticidal activity is against one or more insect pests of the corn rootworm complex: Western corn rootworm, *Diabrotica virgifera virgifera*; northern corn rootworm, *D. barberi*: Southern corn rootworm or spotted cucumber beetle; *Diabrotica undecimpunctata howardi*, and the Mexican corn rootworm, *D. virgifera zeae*. In one embodiment, the insecticidal activity is against Western corn rootworm, *Diabrotica virgifera virgifera*.

In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX module of the Vector NTI Program Suite (Invitrogen Corporation, Carlsbad, Calif.) with all default parameters.

To determine the percent identity of two amino acid sequences or of two nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of one of SEQ ID NO: 1, SEQ ID NO: 2). The percent identity between two sequences can be determined using techniques similar to those described below, with or without allowing gaps. In calculating percent identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, (1990) *Proc. Natl. Acad. Sci. USA* 87:2264, modified as in Karlin and Altschul, (1993) *Proc. Natl. Acad. Sci. USA* 90:5873-5877. Such an algorithm is incorporated into the BLASTN and BLASTX programs of Altschul, et al., (1990) *J. Mol. Biol.* 215:403. BLAST nucleotide searches can be performed with the BLASTN program, score=100, wordlength=12, to obtain nucleic acid sequences homologous to pesticidal nucleic acid molecules of the embodiments. BLAST protein searches can be performed with the BLASTX program, score=50, wordlength=3, to obtain amino acid sequences homologous to pesticidal protein molecules of the embodiments. To obtain gapped alignments for comparison purposes, Gapped BLAST (in BLAST 2.0) can be utilized as described in Altschul, et al., (1997) *Nucleic Acids Res.* 25:3389. Alternatively, PSI-Blast can be used to perform an iterated search that detects distant relationships between molecules. See, Altschul, et al., (1997) supra. When utilizing BLAST, Gapped BLAST, and PSI-Blast programs, the default parameters of the respective programs (e.g., BLASTX and BLASTN) can be used. Alignment may also be performed manually by inspection.

Another non-limiting example of a mathematical algorithm utilized for the comparison of sequences is the ClustalW algorithm (Higgins, et al., (1994) *Nucleic Acids Res.* 22:4673-4680). ClustalW compares sequences and aligns the entirety of the amino acid or DNA sequence, and thus can provide data about the sequence conservation of the entire amino acid sequence. The ClustalW algorithm is used in several commercially available DNA/amino acid analysis software packages, such as the ALIGNX® module of the Vector NTI® Program Suite (Invitrogen Corporation, Carlsbad, Calif.). After alignment of amino acid sequences with ClustalW, the percent amino acid identity can be assessed. A non-limiting example of a software program useful for analysis of ClustalW alignments is GENEDOC™ GENEDOC™ (Karl Nicholas) allows assessment of amino acid (or DNA) similarity and identity between multiple proteins. Another non-limiting example of a mathematical algorithm utilized for the comparison of sequences is the algorithm of Myers and Miller, (1988) *CABIOS* 4:11-17. Such an algorithm is incorporated into the ALIGN program (version 2.0), which is part of the GCG Wisconsin Genetics Software Package, Version 10 (available from Accelrys, Inc., 9685 Scranton Rd., San Diego, Calif., USA). When utilizing the ALIGN program for comparing amino acid sequences, a PAM120 weight residue table, a gap length penalty of 12, and a gap penalty of 4 can be used.

Another non-limiting example of a mathematical algorithm utilized for the comparison of sequences is the algorithm of Needleman and Wunsch, (1970) *J. Mol. Biol.* 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. "Equivalent program" is used herein to refer to any sequence comparison program that, for any two sequences in question, generates an alignment having identical nucleotide residue matches and an identical percent sequence identity when compared to the corresponding alignment generated by GAP Version 10.

The embodiments also encompass nucleic acid molecules encoding PIP-72 polypeptide variants and a silencing element. "Variants" of the nucleic acid sequences disclosed herein include those sequences that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the PIP-72 polypeptides disclosed as discussed below.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) Nat Genet 25(4):436-439; Stemmer, et al., (1999) Tumor Targeting 4:1-4; Ness, et al., (1999) Nat Biotechnol 17:893-896; Chang, et al., (1999) Nat Biotechnol 17:793-797; Minshull and Stemmer, (1999) Curr Opin Chem Biol 3:284-290; Christians, et al., (1999) Nat Biotechnol 17:259-264; Crameri, et al., (1998) Nature 391:288-291; Crameri, et al., (1997) Nat Biotechnol 15:436-438; Zhang, et al., (1997) PNAS USA 94:4504-4509; Patten, et al., (1997) Curr Opin Biotechnol 8:724-733; Crameri, et al., (1996) Nat Med 2:100-103; Crameri, et al., (1996) Nat Biotechnol 14:315-319; Gates, et al., (1996) J Mol Biol 255:373-386; Stemmer, (1996) "Sexual PCR and Assembly PCR" In: The Encyclopedia of Molecular Biology. VCH Publishers, New York. pp. 447-457; Crameri and Stemmer, (1995) BioTechniques 18:194-195; Stemmer, et al., (1995) Gene, 164:49-53; Stemmer, (1995) Science 270: 1510; Stemmer, (1995) Bio/Technology 13:549-553; Stemmer, (1994) Nature 370:389-391 and Stemmer, (1994) PNAS USA 91:10747-10751.

Mutational methods of generating diversity include, for example, site-directed mutagenesis (Ling, et al., (1997) Anal Biochem 254(2):157-178; Dale, et al., (1996) Methods Mol Biol 57:369-374; Smith, (1985) Ann Rev Genet 19:423-462; Botstein and Shortle, (1985) Science 229:1193-1201; Carter, (1986) Biochem J 237:1-7 and Kunkel, (1987) "The efficiency of oligonucleotide directed mutagenesis" in Nucleic Acids & Molecular Biology (Eckstein and Lilley, eds., Springer Verlag, Berlin)); mutagenesis using uracil containing templates (Kunkel, (1985) PNAS USA 82:488-492; Kunkel, et al., (1987) Methods Enzymol 154:367-382 and Bass, et al., (1988) Science 242:240-245); oligonucleotide-directed mutagenesis (Zoller and Smith, (1983) Methods Enzymol 100:468-500; Zoller and Smith, (1987) Methods Enzymol 154:329-350 (1987); Zoller and Smith, (1982) Nucleic Acids Res 10:6487-6500), phosphorothioate-modified DNA mutagenesis (Taylor, et al., (1985) Nucl Acids Res 13:8749-8764; Taylor, et al., (1985) Nucl Acids Res 13:8765-8787 (1985); Nakamaye and Eckstein, (1986) Nucl Acids Res 14:9679-9698; Sayers, et al., (1988) Nucl Acids Res 16:791-802 and Sayers, et al., (1988) Nucl Acids Res 16:803-814); mutagenesis using gapped duplex DNA (Kramer, et al., (1984) Nucl Acids Res 12:9441-9456; Kramer and Fritz, (1987) Methods Enzymol 154:350-367; Kramer, et al., (1988) Nucl Acids Res 16:7207 and Fritz, et al., (1988) Nucl Acids Res 16:6987-6999).

Additional suitable methods include point mismatch repair (Kramer, et al., (1984) Cell 38:879-887), mutagenesis using repair-deficient host strains (Carter, et al., (1985) Nucl Acids Res 13:4431-4443 and Carter, (1987) Methods in Enzymol 154:382-403), deletion mutagenesis (Eghtedarzadeh and Henikoff, (1986) Nucl Acids Res 14:5115), restriction-selection and restriction-purification (Wells, et al., (1986) Phil Trans R Soc Lond A 317:415-423), mutagenesis by total gene synthesis (Nambiar, et al., (1984) Science 223:1299-1301; Sakamar and Khorana, (1988) Nucl Acids Res 14:6361-6372; Wells, et al., (1985) Gene 34:315-323 and Grundström, et al., (1985) Nucl Acids Res 13:3305-3316), double-strand break repair (Mandecki, (1986) PNAS USA, 83:7177-7181 and Arnold, (1993) Curr Opin Biotech 4:450-455). Additional details on many of the above methods can be found in Methods Enzymol Volume 154, which also describes useful controls for trouble-shooting problems with various mutagenesis methods.

Additional details regarding various diversity generating methods can be found in the following US Patents, PCT Publications and Applications and EPO publications: U.S. Pat. Nos. 5,723,323, 5,763,192, 5,814,476, 5,817,483, 5,824,514, 5,976,862, 5,605,793, 5,811,238, 5,830,721, 5,834,252, 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from other organisms. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) Molecular Cloning: A Laboratory Manual (2d ed., Cold Spring Harbor Laboratory Press, Plainview, N.Y.), hereinafter "Sambrook". See also, Innis, et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York). Known methods of PCR include, but are not limited to, methods using paired primers, nested primers, single specific primers, degenerate primers, gene-specific primers, vector-specific primers, partially-mismatched primers, and the like.

Alternatively, mass spectrometry based protein identification method can be used to identify homologs of PIP-72 polypeptides using protocols in the literatures (Scott Patterson, (1998), 10.22, 1-24, Current Protocol in Molecular Biology published by John Wiley & Son Inc.). Specifically, LC-MS/MS based protein identification method is used to associate the MS data of given cell lysate or desired molecular weight enriched samples (excised from SDS-PAGE gel of relevant molecular weight bands to PIP-72) with sequence information of PIP-72 (e.g., SEQ ID NO: 2)) and its homologs. Any match in peptide sequences indicates the potential of having the homologs in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the nucleic acid sequence disclosed herein. Degenerate primers designed on the basis of conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequencedisclosed herein or one or more portions thereof may be used as a probe capable of specifically hybridizing to corresponding nucleic acid sequences encoding PIP-72 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaC., 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the Tm can be approximated from the equation of Meinkoth and Wahl, (1984) Anal. Biochem. 138:267-284: Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization, and/or wash conditions can be adjusted to hybridize to sequences of the desired identity. For example, if sequences with ≥90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3 or 4° C. lower than the thermal melting point (Tm); moderately stringent conditions can utilize a hybridization and/or wash at 6, 7, 8, 9 or 10° C. lower than the thermal melting point (Tm); low stringency conditions can utilize a hybridization and/or wash at 11, 12, 13, 14, 15 or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution), it is preferred to increase the SSC concentration so that a higher temperature can be used. An extensive guide to the hybridization of nucleic acids is found in Tijssen, (1993) Laboratory Techniques in Biochemistry and Molecular Biology-Hybridization with Nucleic Acid Probes, Part I, Chapter 2 (Elsevier, New York); and Ausubel, et al., eds. (1995) Current Protocols in Molecular Biology, Chapter 2 (Greene Publishing and Wiley-Interscience, New York). See, Sambrook, et al., (1989) Molecular Cloning: A Laboratory Manual (2d ed., Cold Spring Harbor Laboratory Press, Cold Spring Harbor, N.Y.).

As used herein, the terms "protein," "peptide molecule," or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used herein to refer to a protein that is no longer in its natural environment, for example in vitro or in a recombinant bacterial or plant host cell. A PIP-72 polypeptide that is substantially free of cellular material includes preparations of protein having less than about 30%, 20%, 10% or 5% (by dry weight) of non-pesticidal protein (also referred to herein as a "contaminating protein").

By "fragment" is intended a portion of the polynucleotide or a portion of the amino acid sequence and hence protein encoded thereby. Fragments of a polynucleotide may encode protein fragments that retain the biological activity of the native protein. Fragments or "biologically active portions" include polypeptide fragments comprising amino acid sequences sufficiently identical to a PIP-72 polypeptide and that exhibit insecticidal activity. Alternatively, fragments of a polynucleotide that are useful as a silencing element do not need to encode fragment proteins that retain biological activity. Thus, fragments of a nucleotide sequence may range from at least about 10, about 15, about 16, about 17, about 18, about 19, nucleotides, about 20 nucleotides, about 22 nucleotides, about 50 nucleotides, about 75 nucleotides, about 100 nucleotides, 200 nucleotides, 300 nucleotides, 400 nucleotides, 500 nucleotides, 600 nucleotides, 700 nucleotides and up to the full-length polynucleotide employed. Alternatively, fragments of a nucleotide sequence may range from 1-50, 25-75, 75-125, 50-100, 125-175, 175-225, 100-150, 100-300, 150-200, 200-250, 225-275, 275-325, 250-300, 325-375, 375-425, 300-350, 350-400, 425-475, 400-450, 475-525, 450-500, 525-575, 575-625, 550-600, 625-675, 675-725, 600-650, 625-675, 675-725, 650-700, 725-825, 825-875, 750-800, 875-925, 925-975, 850-900, 925-975, 975-1025, 950-1000, 1000-1050, 1025-1075, 1075-1125, 1050-1100, 1125-1175, 1100-1200, 1175-1225, 1225-1275, 1200-1300, 1325-1375, 1375-1425, 1300-1400, 1425-1475, 1475-1525, 1400-1500, 1525-1575, 1575-1625, 1625-1675, 1675-1725, 1725-1775, 1775-1825, 1825-1875, 1875-1925, 1925-1975, 1975-2025, 2025-2075, 2075-2125, 2125-2175, 2175-2225, 1500-1600, 1600-1700, 1700-1800, 1800-1900, 1900-2000 of the sequences disclosed herein. A biologically active portion of a PIP-72 polypeptide can be a polypeptide that is, for example, 10, 25, 50, 55, 60, 61, 62, 63, 64, 65, 66, 67, 68, 69, 70, 71, 72, 73, 74, 75, 76, 77, 78, 79, 80, 81, 82, 83, 84 or 85 amino acids in length. Such biologically active portions can be prepared by recombinant techniques and evaluated for insecticidal activity. As used here, a fragment comprises at least 8 contiguous amino acids of a PIP-72 polypeptide.

In some embodiments exemplary PIP-72 polypeptides are set forth in SEQ ID NO: 2, SEQ ID NO: 4, SEQ ID NO: 6, SEQ ID NO: 8, SEQ ID NO: 10, SEQ ID NO: 12, SEQ ID NO: 14; SEQ ID NO: 18, SEQ ID NO: 28, SEQ ID NO: 32, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 546, SEQ ID NO: 547, SEQ ID NO: 548, SEQ ID NO: 549, SEQ ID NO: 550, SEQ ID NO: 551, SEQ ID NO: 552, SEQ ID NO: 553, SEQ ID NO: 554, SEQ ID NO: 555, SEQ ID NO: 556, SEQ ID NO: 557, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 580, SEQ ID NO: 581, SEQ ID NO: 582, SEQ ID NO: 583, SEQ ID NO: 584, SEQ ID NO: 585, SEQ ID NO: 586, SEQ ID NO: 587, SEQ ID NO: 588, SEQ ID NO: 589, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 634, SEQ ID NO: 635, SEQ ID NO: 636, SEQ ID NO: 637, SEQ ID NO: 638, SEQ ID NO: 639, SEQ ID NO: 640, SEQ ID NO: 641, SEQ ID NO: 642, SEQ ID NO: 643, SEQ ID NO: 644, SEQ ID NO: 645, SEQ ID NO: 646, SEQ ID NO: 647, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, SEQ ID NO: 664, SEQ ID NO: 665, SEQ ID NO: 666, SEQ ID NO: 667, SEQ ID NO: 668, SEQ ID NO: 669, SEQ ID NO: 670, SEQ ID NO: 671, SEQ ID NO: 672, SEQ ID NO: 673, SEQ ID NO: 674, SEQ ID NO: 675, SEQ ID NO: 676, SEQ ID NO: 677, SEQ ID NO: 678, SEQ ID NO: 679, SEQ ID NO: 680, SEQ ID NO: 681, SEQ ID NO: 682, SEQ ID NO: 683, SEQ ID NO: 684, SEQ ID NO: 685, SEQ ID NO: 686, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO: 700, SEQ ID NO: 701, SEQ ID NO: 702, SEQ ID NO: 703, SEQ ID NO: 704, SEQ ID NO: 705, SEQ ID NO: 706, SEQ ID NO: 707, SEQ ID NO: 708, SEQ ID NO: 709, SEQ ID NO: 710, SEQ ID NO: 711, SEQ ID NO: 712, SEQ ID NO: 713, SEQ ID NO: 714, SEQ ID NO: 715, SEQ ID NO: 716, SEQ ID NO: 717, SEQ ID NO: 718, SEQ ID NO: 719, SEQ ID NO: 720, SEQ ID NO: 721, SEQ ID NO: 722, SEQ ID NO: 723, SEQ ID NO: 724, SEQ ID NO: 725, SEQ ID NO: 726, SEQ ID NO: 727, SEQ ID NO: 728, SEQ ID NO: 729, SEQ ID NO: 730, SEQ ID NO: 731, SEQ ID NO: 732, SEQ ID NO: 733, SEQ ID NO: 734, SEQ ID NO: 735, SEQ ID NO: 736, SEQ ID NO: 737, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 771, SEQ ID NO: 772, SEQ ID NO: 825, SEQ ID NO: 826, SEQ ID NO: 827, SEQ ID NO: 828, SEQ ID NO: 829, SEQ ID NO: 830, SEQ ID NO: 831, SEQ ID NO: 832, SEQ ID NO: 833, SEQ ID NO: 834, SEQ ID NO: 835, SEQ ID NO: 836, SEQ ID NO: 837, SEQ ID NO: 838, SEQ ID NO: 839, SEQ ID NO: 840, SEQ ID NO: 841, SEQ ID NO: 842, SEQ ID NO: 843, SEQ ID NO: 844, SEQ ID NO: 852, SEQ ID NO: 853, SEQ ID NO: 854, SEQ ID NO: 855, SEQ ID NO: 856, SEQ ID NO: 857, SEQ ID NO: 858, SEQ ID NO: 859, SEQ ID NO: 860, SEQ ID NO: 861, SEQ ID NO: 862, SEQ ID NO: 863, SEQ ID NO: 864, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 913, SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 and SEQ ID NO: 946.

In some embodiments a PIP-72 polypeptide has a calculated molecular weight of between about 6 kDa and about 13 kDa between about 7 kDa and about 12 kDa, between about 8 kDa and about 11 kDa, between about 9 kDa and about 10 kDa, about 8.75 kDa, about 9 kDa, about 9.25 kDa, about 9.5 kDa, about 9.75 kDa, about 10 kDa, about 10.25 kDa, and about 10.5 kDa. As used herein, the term "about" used in the context of molecular weight of a PIP-72 polypeptide means±0.25 kilodaltons.

In some embodiments the PIP-72 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the PIP-72 polypeptide has increased digestibility of proteolytic fragments in an insect gut. Models for digestion by simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al J. *Agric Food Chem.* 50: 7154-7160, 2002).

"Variants" is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. A variant of a polynucleotide that is useful as a silencing element will retain the ability to reduce expression of the target polynucleotide and, in some embodiments, thereby control a plant insect pest of interest. As used herein, a "native" polynucleotide or polypeptide comprises a naturally occurring nucleotide sequence or amino acid sequence, respectively. For polynucleotides, conservative variants include those sequences that, because of the degeneracy of the genetic code, encode the amino acid sequence of one of the disclosed polypeptides. Variant polynucleotides also include synthetically derived polynucleotide, such as those generated, for example, by using site-directed mutagenesis, but continue to retain the desired activity. Generally, variants of a particular disclosed polynucleotide (i.e., a silencing element) will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

Variants of a particular disclosed polynucleotide (i.e., the reference polynucleotide) can also be evaluated by comparison of the percent sequence identity between the polypeptide encoded by a variant polynucleotide and the polypeptide encoded by the reference polynucleotide. Percent sequence identity between any two polypeptides can be calculated using sequence alignment programs and parameters described elsewhere herein. Where any given pair of disclosed polynucleotides employed is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

In some embodiments variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

In another aspect the PIP-72 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.*, 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterfication reaction between the two termini to form a branched ester or thioester intermediate and peptide bond cleavage coupled to cyclization of the intein C-terminal asparagine to free the intein (Evans, et al., (2000) *J. Biol. Chem.*, 275:9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) Proc. Natl. Acad. Sci. USA 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207:187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.,* 120:5591-5592). For the application of inteins in plant transgenes, see, Yang, et al., (*Transgene Res* 15:583-593 (2006)) and Evans, et al., (*Annu. Rev. Plant Biol.* 56:375-392 (2005)).

In another aspect the PIP-72 polypeptide may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the PIP-72 polypeptide and the 3' intein coding sequence is linked to the 5' end of the second fragment coding for the C-terminal part of the PIP-72 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.il/~pietro/inteins/Inteinstable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta.* 1387:422-32). Suitable split inteins may have other purification enabling polypeptide elements added to their structure, provided that such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component is allowed to react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a particular pair of polypeptides is able to associate with each other to provide a functional intein, using routine methods and without the exercise of inventive skill.

The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165: 407-413, 1983). In creating a circular permuted variant a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied in order to span a range from 0 to 50 Å and whose sequence is chosen in order to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile and Salvatore, (1993) *Eur. J. Biochem.* 218:603-621). Thus using either the experimentally derived structural information or predictive methods (e.g., Srinivisan and Rose, (1995) *Proteins: Struct., Funct. & Genetics* 22:81-99) the parental amino acid sequence is inspected to classify regions according to whether or not they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted PIP-72 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted PIP-72 polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

Methods for design and construction of fusion proteins (and polynucleotides encoding same) are known to those of skill in the art. Polynucleotides encoding a PIP-72 polypeptide may be fused to signal sequences which will direct the localization of the PIP-72 polypeptide to particular compartments of a prokaryotic or eukaryotic cell and/or direct the secretion of the PIP-72 polypeptide of the embodiments from a prokaryotic or eukaryotic cell. For example, in *E. coli*, one may wish to direct the expression of the protein to the periplasmic space. Examples of signal sequences or proteins (or fragments thereof) to which the PIP-72 polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs® (240 County Road, Ipswich, Mass. 01938-2723). In a specific embodiment, the PIP-72 polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/polypeptide fusions are well known in the art (see, U.S. Pat. No. 7,193,133). Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the plastid transit peptide and the PIP-72 polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine codon of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity as long as the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9.

In some embodiments fusion proteins are provide comprising a PIP-72 polypeptide, and an insecticidal polypeptide joined by an amino acid linker.

It is recognized that DNA sequences may be altered by various methods, and that these alterations may result in DNA sequences encoding proteins with amino acid sequences different than that encoded by the wild-type (or native) pesticidal protein. In some embodiments a PIP-72 polypeptide may be altered in various ways including amino acid substitutions, deletions, truncations and insertions of one or more amino acids, including up to 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45 or more amino acid substitutions, deletions and/or insertions or combinations thereof compared to the polypeptide sequences disclosed herein.

Methods for such manipulations are generally known in the art. For example, amino acid sequence variants of a PIP-72 polypeptide can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of a PIP-72 polypeptide to confer pesticidal activity may be improved by the use of such techniques upon the compositions of this disclosure.

For example, conservative amino acid substitutions may be made at one or more, predicted, nonessential amino acid residues. A "nonessential" amino acid residue is a residue that can be altered from the wild-type sequence of a PIP-72 polypeptide without altering the biological activity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cysteine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologs). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment of the homologs). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cysteine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred, and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling. With such a procedure, one or more different PIP-72 polypeptide coding regions can be used to create a new PIP-72 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered PIP-72 polypeptides. Domains may be swapped between PIP-72 polypeptides, resulting in hybrid or chimeric toxins with improved insecticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Both DNA shuffling and site-directed mutagenesis were used to define polypeptide sequences that possess pesticidal activity. DNA shuffling was used to generate a library of active variants by recombination of the diversity present in GBP_A3175 (SEQ ID NO: 20) and PIP-72Da (SEQ ID NO: 10). The person skilled in the art will be able to use comparisons to other proteins or functional assays to further define motifs. High throughput screening can be used to test variations of those motifs to determine the role of specific residues. Given that knowledge for several motifs, one can then define the requirements for a functional protein. Knowledge of the motifs allows the skilled artisan to design sequence variations that would not impact function.

Alignment of homologs of PIP-72 homologs allowed identification of residues that are conserved among homologs in this family. Saturation mutagenesis was used to make and test substitutions at selected amino acid positions. These mutants were tested for activity and a number of active substitutions not present among the homologues were identified providing an understanding of the functional constraints at these residues.

Silencing Elements

Silencing elements are provided which, when ingested by the pest, decrease the expression of one or more of the target sequences and thereby controls the pest (i.e., has insecticidal activity).

By "silencing element" is intended a polynucleotide which when contacted by or ingested by a plant insect pest, is capable of reducing or eliminating the level or expression of a target polynucleotide or the polypeptide encoded thereby, and a silencing element may include a polynucleotide that encodes the polynucleotide which when contacted by or ingested by a pest, is capable of reducing or eliminating the level or expression of a target polynucleotide or the polypeptide encoded thereby. Accordingly, it is to be understood that "silencing element," as used herein, comprises polynucleotides such as RNA constructs, DNA constructs that encode the RNA constructs, expression constructs comprising the DNA constructs. In one embodiment, the silencing element employed can reduce or eliminate the expression level of the target sequence by influencing the level of the target RNA transcript or, alternatively, by influencing translation and thereby affecting the level of the encoded polypeptide. Methods to assay for functional silencing elements that are capable of reducing or eliminating the level of a sequence of interest are disclosed elsewhere herein. A single polynucleotide employed in the disclosed methods can comprise one or more silencing elements to the same or different target polynucleotides. The silencing element can be produced in vivo (i.e., in a host cell such as a plant or microorganism) or in vitro. It is to be understood that "silencing element," as used herein, is intended to comprise polynucleotides such as RNA constructs, DNA constructs that encode the RNA constructs, and/or expression constructs comprising the DNA constructs.

As used herein, a "target sequence" or "target polynucleotide" comprises any sequence in the pest that one desires to reduce the level of expression thereof. In specific embodiments, decreasing the level of the target sequence in the pest controls the pest. For instance, the target sequence may be essential for growth and development. As exemplified elsewhere herein, decreasing the level of expression of one or more of these target sequences in a Coleopteran plant pest or a *Diabrotica* plant pest controls the pest. In some embodiments, a target polynucleotide comprises SEQ ID NO: 981, 992, 993, 994, or 995.

In specific embodiments, a silencing element may comprise a chimeric construction molecule comprising two or more disclosed sequences. For example, the chimeric construction may be a hairpin or dsRNA as disclosed herein. A chimera may comprise two or more disclosed sequences. In one embodiment, a chimera contemplates two complementary sequences set forth herein having some degree of mismatch between the complementary sequences such that the two sequences are not perfect complements of one another. Providing at least two different sequences in a single silencing element may allow for targeting multiple genes using one silencing element and/or for example, one expression cassette. Targeting multiple genes may allow for slowing or reducing the possibility of resistance by the pest. In addition, providing multiple targeting ability in one expressed molecule may reduce the expression burden of the transformed plant or plant product, or provide topical treatments that are capable of targeting multiple hosts with one application.

In specific embodiments, the target sequence is not endogenous to the plant. In other embodiments, while the silencing element controls pests, preferably the silencing element has no effect on the normal plant or plant part.

As discussed in further detail, silencing elements can include, but are not limited to, a sense suppression element, an antisense suppression element, a double stranded RNA, a siRNA, a miRNA, or a hairpin suppression element. The silencing element can further comprise additional sequences that advantageously effect transcription and/or the stability of a resulting transcript. For example, the silencing elements can comprise at least one thymine residue at the 3' end. This can aid in stabilization. Thus, the silencing elements can have at least 1, 2, 3, 4, 5, 6, 7, 8, 9, 10 or more thymine residues at the 3' end. As discussed in further detail below, enhancer suppressor elements can also be employed in conjunction with the silencing elements disclosed herein.

In an embodiment, silencing elements may comprise a chimera where two or more disclosed sequences or active fragments or variants, or complements thereof, are found in the same RNA molecule. In various embodiments, a disclosed sequence or active fragment or variant, or complement thereof, may be present as more than one copy in a DNA construct, silencing element, DNA molecule or RNA molecule. In a hairpin or dsRNA molecule, the location of a sense or antisense sequence in the molecule, for example, in which sequence is transcribed first or is located on a particular terminus of the RNA molecule, is not limiting to the disclosed sequences, and the dsRNA is not to be limited by disclosures herein of a particular location for such a sequence.

By "reduces" or "reducing" the expression level of a polynucleotide or a polypeptide encoded thereby is intended to mean, the polynucleotide or polypeptide level of the target sequence is statistically lower than the polynucleotide level or polypeptide level of the same target sequence in an appropriate control pest which is not exposed to (i.e., has not ingested) the silencing element. In particular embodiments of the invention, reducing the polynucleotide level and/or the polypeptide level of the target sequence in a pest according to the invention results in less than 95%, less than 90%, less than 80%, less than 70%, less than 60%, less than 50%, less than 40%, less than 30%, less than 20%, less than 10%, or less than 5% of the polynucleotide level, or the level of the polypeptide encoded thereby, of the same target sequence in an appropriate control pest.

i. Sense Suppression Elements

As used herein, a "sense suppression element" comprises a polynucleotide designed to express an RNA molecule corresponding to at least a part of a target messenger RNA in the "sense" orientation. Expression of the RNA molecule comprising the sense suppression element reduces or eliminates the level of the target polynucleotide or the polypeptide encoded thereby. The polynucleotide comprising the sense suppression element may correspond to all or part of the sequence of the target polynucleotide, all or part of the 5' and/or 3' untranslated region of the target polynucleotide, all or part of the coding sequence of the target polynucleotide, or all or part of both the coding sequence and the untranslated regions of the target polynucleotide.

Typically, a sense suppression element has substantial sequence identity to the target polynucleotide, typically greater than about 65% sequence identity, greater than about 85% sequence identity, about 90%, 91%, 92%, 93%, 94%, 95%, 96%, 97%, 98% or 99% sequence identity. See, U.S. Pat. Nos. 5,283,184 and 5,034,323; herein incorporated by reference. The sense suppression element can be any length so long as it allows for the suppression of the targeted sequence. The sense suppression element can be, for example, 15, 16, 17, 18, 19, 20, 22, 25, 30, 50, 100, 150, 200, 250, 300, 350, 400, 450, 500, 600, 700, 900, 1000, 1100, 1200, 1300 nucleotides or longer of the target polynucleotides. In other embodiments, the sense suppression element can be, for example, about 15-25, 19-35, 19-50, 25-100, 100-150, 150-200, 200-250, 250-300, 300-350, 350-400, 450-500, 500-550, 550-600, 600-650, 650-700, 700-750, 750-800, 800-850, 850-900, 900-950, 950-1000, 1000-1050, 1050-1100, 1100-1200, 1200-1300, 1300-1400, 1400-1500, 1500-1600, 1600-1700, 1700-1800 nucleotides or longer of the target polynucleotides.

ii. Antisense Suppression Elements

As used herein, an "antisense suppression element" comprises a polynucleotide which is designed to express an RNA molecule complementary to all or part of a target messenger RNA. Expression of the antisense RNA suppression element reduces or eliminates the level of the target polynucleotide. The polynucleotide for use in antisense suppression may correspond to all or part of the complement of the sequence encoding the target polynucleotide, all or part of the complement of the 5' and/or 3' untranslated region of the target polynucleotide, all or part of the complement of the coding sequence of the target polynucleotide, or all or part of the complement of both the coding sequence and the untranslated regions of the target polynucleotide. In addition, the antisense suppression element may be fully complementary (i.e., 100% identical to the complement of the target sequence) or partially complementary (i.e., less than 100% identical to the complement of the target sequence) to the target polynucleotide. In specific embodiments, the antisense suppression element comprises at least 85%, 90%, 91%, 92%, 93%, 94%, 95%, 96%, 97%, 98%, or 99% sequence complementarity to the target polynucleotide. Antisense suppression may be used to inhibit the expression of multiple proteins in the same plant. See, for example, U.S. Pat. No. 5,942,657. Furthermore, the antisense suppression element can be complementary to a portion of the target polynucleotide. Generally, sequences of at least 15, 16, 17, 18, 19, 20, 22, 25, 50, 100, 200, 300, 400, 450 nucleotides or greater of the sequence set forth in any of the target polynucleotides may be used. Methods for using antisense suppression to inhibit the expression of endogenous genes in plants are described, for example, in Liu et al (2002) *Plant Physiol.* 129:1732-1743 and U.S. Pat. Nos. 5,759,829 and 5,942,657, each of which is herein incorporated by reference.

iii. Double Stranded RNA Suppression Element

A "double stranded RNA silencing element" or "dsRNA" comprises at least one transcript that is capable of forming a dsRNA either before or after ingestion by a pest. Thus, a "dsRNA silencing element" includes a dsRNA, a transcript or polyribonucleotide capable of forming a dsRNA or more than one transcript or polyribonucleotide capable of forming a dsRNA. "Double stranded RNA" or "dsRNA" refers to a polyribonucleotide structure formed either by a single self-complementary RNA molecule or a polyribonucleotide structure formed by the expression of least two distinct RNA strands. The dsRNA molecule(s) employed in the methods and compositions of the invention mediate the reduction of expression of a target sequence, for example, by mediating RNA interference "RNAi" or gene silencing in a sequence-specific manner. In the context of the present invention, the dsRNA is capable of reducing or eliminating the level or expression of at least one target polynucleotide or polypeptide encoded thereby in a pest.

The dsRNA can reduce or eliminate the expression level of the target sequence by influencing the level of the target RNA transcript, by influencing translation and thereby affecting the level of the encoded polypeptide, or by influencing expression at the pre-transcriptional level (i.e., via the modulation of chromatin structure, methylation pattern, etc., to alter gene expression). See, for example, Verdel et al. (2004) *Science* 303:672-676; Pal-Bhadra et al. (2004) *Science* 303:669-672; Allshire (2002) *Science* 297:1818-1819; Volpe et al. (2002) *Science* 297:1833-1837; Jenuwein (2002) *Science* 297:2215-2218; and Hall et al. (2002) *Science* 297:2232-2237. Methods to assay for functional dsRNA that are capable of reducing or eliminating the level of a sequence of interest are disclosed elsewhere herein. Accordingly, as used herein, the term "dsRNA" is meant to encompass other terms used to describe nucleic acid molecules that are capable of mediating RNA interference or gene silencing, including, for example, short-interfering RNA (siRNA), double-stranded RNA (dsRNA), micro-RNA (miRNA), hairpin RNA, short hairpin RNA (shRNA), post-transcriptional gene silencing RNA (ptgsRNA), and others.

In specific embodiments, at least one strand of the duplex or double-stranded region of the dsRNA shares sufficient sequence identity or sequence complementarity to the target polynucleotide to allow for the dsRNA to reduce the level of expression of the target sequence. As used herein, the strand that is complementary to the target polynucleotide is the "antisense strand" and the strand homologous to the target polynucleotide is the "sense strand."

In another embodiment, the dsRNA comprises a hairpin RNA. A hairpin RNA comprises an RNA molecule that is capable of folding back onto itself to form a double stranded structure. Multiple structures can be employed as hairpin elements. In specific embodiments, the dsRNA suppression element comprises a hairpin element which comprises in the following order, a first segment, a second segment, and a third segment, where the first and the third segment share sufficient complementarity to allow the transcribed RNA to form a double-stranded stem-loop structure.

The "second segment" of the hairpin comprises a "loop" or a "loop region." These terms are used synonymously herein and are to be construed broadly to comprise any nucleotide sequence that confers enough flexibility to allow self-pairing to occur between complementary regions of a polynucleotide (i.e., segments 1 and 3 which form the stem of the hairpin). For example, in some embodiments, the loop region may be substantially single stranded and act as a spacer between the self-complementary regions of the hairpin stem-loop. In some embodiments, the loop region can comprise a random or nonsense nucleotide sequence and thus not share sequence identity to a target polynucleotide. In other embodiments, the loop region comprises a sense or an antisense RNA sequence or fragment thereof that shares identity to a target polynucleotide. See, for example, International Patent Publication No. WO 02/00904, herein incorporated by reference. In specific embodiments, the loop region can be optimized to be as short as possible while still providing enough intramolecular flexibility to allow the formation of the base-paired stem region. Accordingly, the loop sequence is generally less than 1000, 900, 800, 700, 600, 500, 400, 300, 200, 100, 50, 25, 20, 19, 18, 17, 16, 15, 10 nucleotides or less.

The "first" and the "third" segment of the hairpin RNA molecule comprise the base-paired stem of the hairpin structure. The first and the third segments are inverted repeats of one another and share sufficient complementarity to allow the formation of the base-paired stem region. In specific embodiments, the first and the third segments are fully complementary to one another. Alternatively, the first and the third segment may be partially complementary to each other so long as they are capable of hybridizing to one another to form a base-paired stem region. The amount of complementarity between the first and the third segment can be calculated as a percentage of the entire segment. Thus, the first and the third segment of the hairpin RNA generally share at least 50%, 60%, 70%, 80%, 85%, 90%, 91%, 92%, 93%, 94%, 95%, 96%, 97%, 98%, 99%, up to and including 100% complementarity.

The first and the third segment are at least about 1000, 500, 475, 450, 425, 400, 375, 350, 325, 300, 250, 225, 200, 175, 150, 125, 100, 75, 60, 50, 40, 30, 25, 22, 20, 19, 18, 17, 16, 15 or 10 nucleotides in length. In specific embodiments, the length of the first and/or the third segment is about 10-100 nucleotides, about 10 to about 75 nucleotides, about 10 to about 50 nucleotides, about 10 to about 40 nucleotides, about 10 to about 35 nucleotides, about 10 to about 30 nucleotides, about 10 to about 25 nucleotides, about 10 to about 19 nucleotides, about 10 to about 20 nucleotides, about 19 to about 50 nucleotides, about 50 nucleotides to about 100 nucleotides, about 100 nucleotides to about 150 nucleotides, about 100 nucleotides to about 300 nucleotides, about 150 nucleotides to about 200 nucleotides, about 200 nucleotides to about 250 nucleotides, about 250 nucleotides to about 300 nucleotides, about 300 nucleotides to about 350 nucleotides, about 350 nucleotides to about 400 nucleotides, about 400 nucleotide to about 500 nucleotides, about 600 nt, about 700 nt, about 800 nt, about 900 nt, about 1000 nt, about 1100 nt, about 1200 nt, 1300 nt, 1400 nt, 1500 nt, 1600 nt, 1700 nt, 1800 nt, 1900 nt, 2000 nt or longer. In other embodiments, the length of the first and/or the third segment comprises at least 10-19 nucleotides, 10-20 nucleotides; 19-35 nucleotides, 20-35 nucleotides; 30-45 nucleotides; 40-50 nucleotides; 50-100 nucleotides; 100-300 nucleotides; about 500-700 nucleotides; about 700-900 nucleotides; about 900-1100 nucleotides; about 1300-1500 nucleotides; about 1500-1700 nucleotides; about 1700-1900 nucleotides; about 1900-2100 nucleotides; about 2100-2300 nucleotides; or about 2300-2500 nucleotides. See, for example, International Application Publication No. WO02/00904. In specific embodiments, the first and the third segment comprise at least 20 nucleotides having at least 85% complementary to the first segment. In still other embodiments, the first and the third segments which form the stem-loop structure of the hairpin comprises 3' or 5' overhang regions having unpaired nucleotide residues.

The disclosed hairpin molecules or double-stranded RNA molecules may have more than one target sequence or active fragments or variants, or complements thereof, found in the same portion of the RNA molecule. For example, in a chimeric hairpin structure, the first segment of a hairpin molecule comprises two polynucleotide sections, each with a different target sequence. For example, reading from one terminus of the hairpin, the first segment is composed of sequences from two separate genes (A followed by B). This first segment is followed by the second segment, the loop portion of the hairpin. The loop segment is followed by the third segment, where the complementary strands of the sequences in the first segment are found (B* followed by A*) in forming the stem-loop, hairpin structure, the stem contains SeqA-A* at the distal end of the stem and SeqB-B* proximal to the loop region.

In specific embodiments, the sequences used in the first, the second, and/or the third segments comprise domains that are designed to have sufficient sequence identity to a target polynucleotide of interest and thereby have the ability to decrease the level of expression of the target polynucleotide. The specificity of the inhibitory RNA transcripts is therefore generally conferred by these domains of the silencing element. Thus, in some embodiments, the first, second and/or third segment of the silencing element comprise a domain having at least 10, at least 15, at least 19, at least 20, at least 21, at least 22, at least 23, at least 24, at least 25, at least 30, at least 40, at least 50, at least 100, at least 200, at least 300, at least 500, at least 1000, or more than 1000 nucleotides that share sufficient sequence identity to the target polynucleotide to allow for a decrease in expression levels of the target polynucleotide when expressed in an appropriate cell. In other embodiments, the domain is between about 15 to 50 nucleotides, about 19-35 nucleotides, about 20-35 nucleotides, about 25-50 nucleotides, about 19 to 75 nucleotides, about 20 to 75 nucleotides, about 40-90 nucleotides about 15-100 nucleotides, 10-100 nucleotides, about 10 to about 75 nucleotides, about 10 to about 50 nucleotides, about 10 to about 40 nucleotides, about 10 to about 35 nucleotides, about 10 to about 30 nucleotides, about 10 to about 25 nucleotides, about 10 to about 20 nucleotides, about 10 to about 19 nucleotides, about 50 nucleotides to about 100 nucleotides, about 100 nucleotides to about 150 nucleotides, about 150 nucleotides to about 200 nucleotides, about 200 nucleotides to about 250 nucleotides, about 250 nucleotides to about 300 nucleotides, about 300 nucleotides to about 350 nucleotides, about 350 nucleotides to about 400 nucleotides, about 400 nucleotide to about 500 nucleotides or longer. In other embodiments, the length of the first and/or the third segment comprises at least 10-20 nucleotides, at least 10-19 nucleotides, 20-35 nucleotides, 30-45 nucleotides, 40-50 nucleotides, 50-100 nucleotides, or about 100-300 nucleotides.

In specific embodiments, the domain of the first, the second, and/or the third segment has 100% sequence identity to the target polynucleotide. In other embodiments, the domain of the first, the second and/or the third segment having homology to the target polypeptide have at least 50%, 60%, 70%, 80%, 85%, 90%, 91%, 92%, 93%, 94%, 95%, 96%, 97%, 98%, 99%, or greater sequence identity to a region of the target polynucleotide. The sequence identity of the domains of the first, the second and/or the third segments to the target polynucleotide need only be sufficient to decrease expression of the target polynucleotide of interest. See, for example, Chuang and Meyerowitz (2000) *Proc. Natl. Acad. Sci. USA* 97:4985-4990; Stoutjesdijk et al. (2002) *Plant Physiol.* 129:1723-1731; Waterhouse and Helliwell (2003) *Nat. Rev. Genet.* 4:29-38; Pandolfini et al. *BMC Biotechnology* 3:7, and U.S. Patent Publication No. 20030175965; each of which is herein incorporated by reference. A transient assay for the efficiency of hpRNA constructs to silence gene expression in vivo has been described by Panstruga et al. (2003) *Mol. Biol. Rep.* 30:135-140.

The amount of complementarity shared between the first, second, and/or third segment and the target polynucleotide or the amount of complementarity shared between the first segment and the third segment (i.e., the stem of the hairpin structure) may vary depending on the organism in which gene expression is to be controlled. Some organisms or cell types may require exact pairing or 100% identity, while other organisms or cell types may tolerate some mismatching. In some cells, for example, a single nucleotide mismatch in the targeting sequence abrogates the ability to suppress gene expression. In these cells, the disclosed suppression cassettes can be used to target the suppression of mutant genes, for example, oncogenes whose transcripts comprise point mutations and therefore they can be specifically targeted using the methods and compositions disclosed herein without altering the expression of the remaining wild-type allele. In other organisms, holistic sequence variability may be tolerated as long as some 22 nt region of the sequence is represented in 100% homology between target polynucleotide and the suppression cassette.

In other embodiments, the silencing element can comprise a small RNA (sRNA). sRNAs can comprise both micro RNA (miRNA) and short-interfering RNA (siRNA) (Meister and Tuschl (2004) *Nature* 431:343-349 and Bonetta et al. (2004) *Nature Methods* 1:79-86). miRNAs are regulatory agents comprising about 19 to about 24 ribonucleotides in length which are highly efficient at inhibiting the expression of target polynucleotides. See, for example Javier et al. 10 (2003) *Nature* 425: 257-263, herein incorporated by reference. For miRNA interference, the silencing element can be designed to express a dsRNA molecule that forms a hairpin structure or partially base-paired structure containing 19, 20, 21, 22, 23, 24 or 25-nucleotide sequence that is complementary to the target polynucleotide of interest. The miRNA can be synthetically made, or transcribed as a longer RNA which is subsequently cleaved to produce the active miRNA. 15 Specifically, the miRNA can comprise 19 nucleotides of the sequence having homology to a target polynucleotide in sense orientation and 19 nucleotides of a corresponding antisense sequence that is complementary to the sense sequence. The miRNA can be an "artificial miRNA" or "amiRNA" which comprises a miRNA sequence that is synthetically designed to silence a target sequence.

The methods and compositions disclosed herein employ silencing elements that when transcribed "form" a dsRNA molecule. Accordingly, the heterologous polynucleotide being expressed need not form the dsRNA by itself, but can interact with other sequences in the plant cell or in the pest gut after ingestion to allow the formation of the dsRNA. For example, a chimeric polynucleotide that can selectively silence the target polynucleotide can be generated by expressing a chimeric construct comprising the target sequence for a miRNA or siRNA to a sequence corresponding to all or part of the gene or genes to be silenced. In this embodiment, the dsRNA is "formed" when the target for the miRNA or siRNA interacts with the miRNA present in the cell. The resulting dsRNA can then reduce the level of expression of the gene or genes to be silenced. See, for example, US Patent Application Publication Number 2007-0130653, entitled "Methods and Compositions for Gene Silencing." The construct can be designed to have a target for an endogenous miRNA or alternatively, a target for a heterologous and/or synthetic miRNA can be employed in the construct. If a heterologous and/or synthetic miRNA is employed, it can be introduced into the cell on the same nucleotide construct as the chimeric polynucleotide or on a separate construct. As discussed elsewhere herein, any method can be used to introduce the construct comprising the heterologous miRNA.

As used herein, by "controlling a pest" or "controls a pest" is intended any affect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack, or deterring the pests from eating the plant.

Reducing the level of expression of the target polynucleotide or the polypeptide encoded thereby, in the pest results in the suppression, control, and/or killing the invading pathogenic organism. Reducing the level of expression of the target sequence of the pest will reduce the disease symptoms resulting from pathogen challenge by at least about 2% to at least about 6%, at least about 5% to about 50%, at least about 10% to about 60%, at least about 30% to about 70%, at least about 40% to about 80%, or at least about 50% to about 90% or greater. Hence, the methods of the invention can be utilized to control pests, particularly, Coleopteran plant pest or a *Diabrotica* plant pest.

Assays that measure the control of a pest are commonly known in the art, as are methods to quantitate disease resistance in plants following pathogen infection. See, for example, U.S. Pat. No. 5,614,395, herein incorporated by reference. Such techniques include, measuring over time, the average lesion diameter, the pathogen biomass, and the overall percentage of decayed plant tissues. See, for example, Thomma et al. (1998) *Plant Biology* 95:15107-15111, herein incorporated by reference. See, also Baum et al. (2007) *Nature Biotech* 11:1322-1326 and WO 2007/035650 which proved both whole plant feeding assays and corn root feeding assays. Both of these references are herein incorporated by reference in their entirety.

Compositions

Compositions comprising a PIP-72 polypeptide and a silencing element are also embraced. In some embodiments the composition comprises a RyanR (SEQ ID NO: 992), HP2 SEQ ID NO: 994), or RPS10 (SEQ ID NO: 995) target silencing element. In one embodiment, the composition comprises a PIP-72 polypeptide and a silencing element, wherein the silencing element comprises any one of SEQ ID NOs: 982-991, 993, or SEQ ID NOs: 561-572 of US Patent Application Publication No. US2014/0275208 and US2015/0257389.

One or more of the polynucleotides comprising the silencing element can be provided as an external composition such as a spray or powder to the plant, plant part, seed, a plant insect pest, or an area of cultivation. It is recognized that the composition can comprise a cell (such as plant cell or a bacterial cell), in which a polynucleotide encoding a PIP-72 and a silencing element is stably incorporated into the genome and operably linked to promoters active in the cell. In other embodiments, compositions comprising the PIP-72 and a silencing element are not contained in a cell. In such embodiments, the composition can be applied to an area inhabited by a plant insect pest. In one embodiment, the composition is applied externally to a plant (i.e., by spraying a field or area of cultivation) to protect the plant from the pest. Methods of applying nucleotides in such a manner are known to those of skill in the art.

The composition of the invention can further be formulated as bait. In this embodiment, the compositions comprise a food substance or an attractant which enhances the attractiveness of the composition to the pest.

The composition comprising a PIP-72 and a silencing element can be formulated in an agriculturally suitable and/or environmentally acceptable carrier. Such carriers can be any material that the animal, plant or environment to be treated can tolerate. Furthermore, the carrier must be such that the composition remains effective at controlling a plant insect pest. Examples of such carriers include water, saline, Ringer's solution, dextrose or other sugar solutions, Hank's solution, and other aqueous physiologically balanced salt solutions, phosphate buffer, bicarbonate buffer and Tris buffer. In addition, the composition may include compounds that increase the half-life of a composition. Various insecticidal formulations can also be found in, for example, US Patent Application Publication Numbers 2008/0275115, 2008/0242174, 2008/0027143, 2005/0042245, and 2004/0127520, each of which is herein incorporated by reference.

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. Where the promoter is a native or natural sequence, the expression of the operably linked sequence is altered from the wild-type expression, which results in an alteration in phenotype.

The polynucleotide encoding the silencing element or in specific embodiments employed in the disclosed methods and compositions can be provided in expression cassettes for expression in a plant or organism of interest. It is recognized that multiple silencing elements including multiple identical silencing elements, multiple silencing elements targeting different regions of the target sequence, or multiple silencing elements from different target sequences can be used. In this embodiment, it is recognized that each silencing element can be contained in a single or separate cassette, DNA construct, or vector. As discussed, any means of providing the silencing element is contemplated.

In other embodiment, the double stranded RNA is expressed from a suppression cassette. Such a cassette can comprise two convergent promoters that drive transcription of an operably linked silencing element. "Convergent promoters" refers to promoters that are oriented on either terminus of the operably linked silencing element such that each promoter drives transcription of the silencing element in opposite directions, yielding two transcripts. In such embodiments, the convergent promoters allow for the transcription of the sense and anti-sense strand and thus allow for the formation of a dsRNA. Such a cassette may also comprise two divergent promoters that drive transcription of one or more operably linked silencing elements. "Divergent promoters" refers to promoters that are oriented in opposite directions of each other, driving transcription of the one or more silencing elements in opposite directions. In such embodiments, the divergent promoters allow for the transcription of the sense and antisense strands and allow for the formation of a dsRNA. In such embodiments, the divergent promoters also allow for the transcription of at least two separate hairpin RNAs. In another embodiment, one cassette comprising two or more silencing elements under the control of two separate promoters in the same orientation is present in a construct. In another embodiment, two or more individual cassettes, each comprising at least one silencing element under the control of a promoter, are present in a construct in the same orientation.

In some embodiments the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464; Christensen and Quail (1996) *Transgenic Res.* 5:213-218; Christensen et al. (1992) *Plant Molecular Biology* 18:675-689)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96), the maize Adh1 intron (Kyozuka et al. (1991) *Mol. Gen. Genet.* 228:40-48; Kyozuka et al. (1990) *Maydica* 35:353-357), the enhancers of U.S. Pat. No. 7,803,992, and the sugarcane bacilliform viral (SCBV) enhancer of WO2013130813 may also be used, each of which is incorporated by reference. The above list of transcriptional enhancers is not meant to be limiting. Any appropriate transcriptional enhancer can be used in the embodiments.

In some embdodiments, a DNA construct comprises polynucleotides encoding PIP-72 polypeptide and a silencing element. In one embodiment, a DNA construct comprises polynucleotides encoding a PIP-72 polypeptide and a silencing element, wherein the silencing element targets RyanR (SEQ ID NO: 992), HP2 SEQ ID NO: 994), or RPS10 (SEQ ID NO: 995). In another embodiment, a DNA construct comprises polynucleotides encoding a PIP-72 polypeptide and a silencing element, wherein the silencing element comprises any one of SEQ ID NOs: 982-991, 993, or SEQ ID NOs: 561-572 of US Patent Application Publication No. US2014/0275208 and US2015/0257389.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, and Liu H et al. *Mol Bio Rep* 37:677-684, 2010, herein incorporated by reference. A *Zea* maize codon usage table can be found at kazusa.or.jp/codon/cgi-bin/showcodon.cgi?species=4577, which can be accessed using the www prefix.

A *Glycine max* codon usage table can be found at kazusa.or.jp/codon/cgi-bin/showcodon.cgi?species=3847&aa=1&style=N, which can be accessed using the www prefix.

In some embodiments the recombinant nucleic acid molecule encoding a PIP-72 polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA*, ed. Cech (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are proteolytically activated in the gut of the target pest (Chang, (1987) *Methods Enzymol.* 153:507-516). In some embodiments, the signal sequence is located in the native sequence or may be derived from a sequence of the embodiments. "Leader sequence" as used herein refers to any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. Plant Cell 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., Photosynthesis Research, 78:249-264, 2003. In particular, Table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, *Science* 296:92-100, 2002) is a suitable source for lumen targeting signal peptide which may be used in accordance with the present disclosure.

Suitable chloroplast transit peptides (CTP) are well known to one skilled in the art also include chimeric CTPs comprising but not limited to, an N-terminal domain, a central domain or a C-terminal domain from a CTP from *Oryza sativa* 1-deoxy-D xyulose-5-Phosphate Synthase *Oryza sativa*-Superoxide dismutase *Oryza sativa*-soluble starch synthase *Oryza sativa*-NADP-dependent Malic acid enzyme *Oryza sativa*-Phospho-2-dehydro-3-deoxyheptonate Aldolase 2 *Oryza sativa*-L-Ascorbate peroxidase 5 *Oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type (US Patent Application Publication 2012/0304336). Chloroplast transit peptides of US Patent Publications US20130205440A1, US20130205441A1 and US20130210114A1.

The PIP-72 polypeptide gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Promoters of the present invention include homologues of cis elements known to effect gene regulation that show homology with the promoter sequences of the present invention. These cis elements include, but are not limited to, oxygen responsive cis elements (Cowen et al., J Biol. Chem. 268(36):26904-26910 (1993)), light regulatory elements (Bruce and Quaill, Plant Cell 2 (11):1081-1089 (1990); Bruce et al., EMBO J. 10:3015-3024 (1991); Rocholl et al., Plant Sci. 97:189-198 (1994); Block et al., Proc. Natl. Acad. Sci. USA 87:5387-5391 (1990); Giuliano et al., Proc. Natl. Acad. Sci. USA 85:7089-7093 (1988); Staiger et al., Proc. Natl. Acad. Sci. USA 86:6930-6934 (1989); Izawa et al., Plant Cell 6:1277-1287 (1994); Menkens et al., Trends in Biochemistry 20:506-510 (1995); Foster et al., FASEB J. 8:192-200 (1994); Plesse et al., Mol Gen Gene 254:258-266 (1997); Green et al., EMBO J. 6:2543-2549 (1987); Kuhlemeier et al., Ann. Rev Plant Physiol. 38:221-257 (1987); Villain et al., J. Biol. Chem. 271:32593-32598 (1996); Lam et al., Plant Cell 2:857-866 (1990); Gilmartin et al., Plant Cell 2:369-378 (1990); Datta et al., Plant Cell 1:1069-1077 (1989); Gilmartin et al., Plant Cell 2:369-378 (1990); Castresana et al., EMBO J. 7:1929-1936 (1988); Ueda et al., Plant Cell 1:217-227 (1989); Terzaghi et al., Annu. Rev. Plant Physiol. Plant Mol. Biol. 46:445-474 (1995); Green et al., EMBO J. 6:2543-2549 (1987); Villain et al., J. Biol. Chem. 271:32593-32598 (1996); Tjaden et al., Plant Cell 6:107-118 (1994); Tjaden et al., Plant Physiol. 108:1109-1117 (1995); Ngai et al., Plant J. 12:1021-1234 (1997); Bruce et al., EMBO J. 10:3015-3024 (1991); Ngai et al., Plant J. 12:1021-1034 (1997)), elements responsive to gibberellin, (Muller et al., J. Plant Physiol. 145:606-613 (1995); Croissant et al., Plant Science 116:27-35 (1996); Lohmer et al., EMBO J. 10:617-624 (1991); Rogers et al., Plant Cell 4:1443-1451 (1992); Lanahan et al., Plant Cell 4:203-211 (1992); Skriver et al., Proc. Natl. Acad. Sci. USA 88:7266-7270 (1991); Gilmartin et al., Plant Cell 2:369-378 (1990); Huang et al., Plant Mol. Biol. 14:655-668 (1990), Gubler et al., Plant Cell 7:1879-1891 (1995)), elements responsive to abscisic acid, (Busk et al., Plant Cell 9:2261-2270 (1997); Guiltinan et al., Science 250:267-270 (1990); Shen et al., Plant Cell 7:295-307 (1995); Shen et al., Plant Cell 8:1107-1119 (1996); Seo et al., Plant Mol. Biol. 27:1119-1131 (1995); Marcotte et al., Plant Cell 1:969-976 (1989); Shen et al., Plant Cell 7:295-307 (1995); Iwasaki et al., Mol Gen Genet 247:391-398 (1995); Hattori et al., Genes Dev. 6:609-618 (1992); Thomas et al., Plant Cell 5:1401-1410 (1993)), elements similar to abscisic acid responsive elements, (Ellerstrom et al., Plant Mol. Biol. 32:1019-1027 (1996)), auxin responsive elements (Liu et al., Plant Cell 6:645-657 (1994); Liu et al., Plant Physiol. 115:397-407 (1997); Kosugi et al., Plant J. 7:877-886 (1995); Kosugi et al., Plant Cell 9:1607-1619 (1997); Ballas et al., J. Mol. Biol. 233: 580-596 (1993)), a cis element responsive to methyl jasmonate treatment (Beaudoin and Rothstein, Plant Mol. Biol. 33:835-846 (1997)), a cis element responsive to abscisic acid and stress response (Straub et al., Plant Mol. Biol. 26:617-630 (1994)), ethylene responsive cis elements (Itzhaki et al., Proc. Natl. Acad. Sci. USA 91:8925-8929 (1994); Montgomery et al., Proc. Natl. Acad. Sci. USA 90:5939-5943 (1993); Sessa et al., Plant Mol. Biol. 28:145-153 (1995); Shinshi et al., Plant Mol. Biol. 27:923-932 (1995)), salicylic acid cis responsive elements, (Strange et al., Plant J. 11:1315-1324 (1997); Qin et al., Plant Cell 6:863-874 (1994)), a cis element that responds to water stress and abscisic acid (Lam et al., J. Biol. Chem. 266: 17131-17135 (1991); Thomas et al., Plant Cell 5:1401-1410 (1993); Pla et al., Plant Mol Biol 21:259-266 (1993)), a cis element essential for M phase-specific expression (Ito et al., Plant Cell 10:331-341 (1998)), sucrose responsive elements (Huang et al., Plant Mol. Biol. 14:655-668 (1990); Hwang et al., Plant Mol Biol 36:331-341 (1998); Grierson et al., Plant J. 5:815-826 (1994)), heat shock response elements (Pelham et al., Trends Genet. 1:31-35 (1985)), elements responsive to auxin and/or salicylic acid and also reported for light regulation (Lam et al., Proc. Natl. Acad. Sci. USA 86:7890-7897 (1989); Benfey et al., Science 250:959-966 (1990)), elements responsive to ethylene and salicylic acid (Ohme-Takagi et al., Plant Mol. Biol. 15:941-946 (1990)), elements responsive to wounding and abiotic stress (Loake et al., Proc. Natl. Acad. Sci. USA 89:9230-9234 (1992); Mhiri et al., Plant Mol. Biol. 33:257-266 (1997)), antioxidant response elements (Rushmore et al., J. Biol. Chem. 266: 11632-11639; Dalton et al., Nucleic Acids Res. 22:5016-5023 (1994)), Sph elements (Suzuki et al., Plant Cell 9:799-807 1997)), elicitor responsive elements, (Fukuda et al., Plant Mol. Biol. 34:81-87 (1997); Rushton et al., EMBO J. 15:5690-5700 (1996)), metal responsive elements (Stuart et al., Nature 317:828-831 (1985); Westin et al., EMBO J. 7:3763-3770 (1988); Thiele et al., Nucleic Acids Res. 20:1183-1191 (1992); Faisst et al., Nucleic Acids Res. 20:3-26 (1992)), low temperature responsive elements, (Baker et al., Plant Mol. Biol. 24:701-713 (1994); Jiang et al., Plant Mol. Biol. 30:679-684 (1996); Nordin et al., Plant Mol. Biol. 21:641-653 (1993); Zhou et al., J. Biol. Chem. 267:23515-23519 (1992)), drought responsive elements, (Yamaguchi et al., Plant Cell 6:251-264 (1994); Wang et al., Plant Mol. Biol. 28:605-617 (1995); Bray E A, Trends in Plant Science 2:48-54 (1997)) enhancer elements for glutenin, (Colot et al., EMBO J. 6:3559-3564 (1987); Thomas et al., Plant Cell 2:1171-1180 (1990); Kreis et al., Philos. Trans. R. Soc. Lond., B314:355-365 (1986)), light-independent regulatory elements, (Lagrange et al., Plant Cell 9:1469-1479 (1997); Villain et al., J. Biol. Chem. 271: 32593-32598 (1996)), OCS enhancer elements, (Bouchez et al., EMBO J. 8:4197-4204 (1989); Foley et al., Plant J. 3:669-679 (1993)), ACGT elements, (Foster et al., FASEB J. 8:192-200 (1994); Izawa et al., Plant Cell 6:1277-1287 (1994); Izawa et al., J. Mol. Biol. 230:1131-1144 (1993)), negative cis elements in plastid related genes, (Zhou et al., J. Biol. Chem. 267:23515-23519 (1992); Lagrange et al., Mol. Cell Biol. 13:2614-2622 (1993); Lagrange et al., Plant Cell 9:1469-1479 (1997); Zhou et al., J. Biol. Chem. 267: 23515-23519 (1992)), prolamin box elements, (Forde et al., Nucleic Acids Res. 13:7327-7339 (1985); Colot et al., EMBO J. 6:3559-3564 (1987); Thomas et al., Plant Cell 2:1171-1180 (1990); Thompson et al., Plant Mol. Biol. 15:755-764 (1990); Vicente et al., Proc. Natl. Acad. Sci. USA 94:7685-7690 (1997)), elements in enhancers from the IgM heavy chain gene (Gillies et al., Cell 33:717-728 (1983); Whittier et al., Nucleic Acids Res. 15:2515-2535 (1987)). Examples of promoters include: those described in U.S. Pat. No. 6,437,217 (maize RS81 promoter), U.S. Pat. No. 5,641,876 (rice actin promoter), U.S. Pat. No. 6,426,446 (maize RS324 promoter), U.S. Pat. No. 6,429,362 (maize PR-1 promoter), U.S. Pat. No. 6,232,526 (maize A3 promoter), U.S. Pat. No. 6,177,611 (constitutive maize promoters), U.S. Pat. Nos. 5,322,938, 5,352,605, 5,359,142 and 5,530,196 (35S promoter), U.S. Pat. No. 6,433,252 (maize L3 oleosin promoter, P-Zm.L3), U.S. Pat. No. 6,429,357 (rice actin 2 promoter as well as a rice actin 2 intron), U.S. Pat. No. 5,837,848 (root specific promoter), U.S. Pat. No. 6,294,714 (light inducible promoters), U.S. Pat. No. 6,140, 078 (salt inducible promoters), U.S. Pat. No. 6,252,138 (pathogen inducible promoters), U.S. Pat. No. 6,175,060 (phosphorus deficiency inducible promoters), U.S. Pat. No. 6,635,806 (gama-coixin promoter, P-y.Gcx), U.S. patent application Ser. No. 09/757,089 (maize chloroplast aldolase promoter), and U.S. Pat. No. 8,772,466 (maize transcription factor Nuclear Factor B (NFB2)).

Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos. 5,608,149; 5,608,144; 5,604, 121; 5,569,597; 5,466,785; 5,399,680; 5,268,463; 5,608,142 and 6,177,611. Suitable constitutive promoters also include promoters that have strong expression in nearly all tissues but have low expression in pollen, including but not limited to: Banana Streak Virus (Acuminata Yunnan) promoters (BSV(AY)) disclosed in US patent U.S. Pat. No. 8,338,662; Banana Streak Virus (Acuminata Vietnam) promoters (BSV (AV)) disclosed in US patent U.S. Pat. No. 8,350,121; and Banana Streak Virus (Mysore) promoters (BSV(MYS)) disclosed in US patent U.S. Pat. No. 8,395,022.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4: 645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-la promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced PIP-72 polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7):792-803; Hansen, et al., (1997) *Mol. Gen Genet.* 254(3):337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5):773-778; Lam, (1994) *Results Probl. Cell Differ.* 20:181-196; Orozco, et al., (1993) *Plant Mol Biol.* 23(6):1129-1138; Matsuoka, et al., (1993) *Proc Natl. Acad. Sci. USA* 90(20):9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, *Plant Science* (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2): 343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US Patent Application US20130117883. Root-preferred sorghum (*Sorghum bicolor*) RCc3 promoters are disclosed in US Patent Application US20120210463. The root-preferred maize promoters of US Patent Application Publication 20030131377, U.S. Pat. Nos. 7,645,919, and 8,735,655. The root cap-specific 1 (ZmRCP1) maize promoters of US Patent Application Publication 20130025000. The root-preferred maize promoters of US Patent Application Publication 20130312136.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis*, p26, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) Ph.D. Thesis, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ Culture: Fundamental Methods*, ed. Gamborg and Phillips, (Springer-Verlag, Berlin) and McCabe, et al., (1988) *Biotechnology* 6:923-926) and Lecl transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, New York), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the PIP-72 polypeptide or variants and fragments thereof and a polynucleotide encoding a silencing element directly into the plant or the introduction of the PIP-72 polypeptide transcript and a silencing element into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107:775-784, all of which are herein incorporated by reference. Alternatively, the PIP-72 polypeptide polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma # P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired PIP-72 polypeptide. It is also recognized that such a viral polyprotein, comprising at least a portion of the amino acid sequence of a PIP-72 polypeptide of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367 and 5,316,931; herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), Brassica sp. (e.g., *B. napus, B. rapa, B. juncea*), particularly those Brassica species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, Brassica, soybean, cotton, safflower, peanut, sorghum, wheat, millet, tobacco, etc.), such as corn and soybean plants.

Turf grasses include, but are not limited to: annual bluegrass (*Poa annus*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovini*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, Brassica, maize, alfalfa, palm, coconut, flax, castor, olive, etc. Leguminous plants include beans and peas. Beans include guar, locust bean, fenugreek, soybean, garden beans, cowpea, mung bean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the PIP-72 polypeptide.

Stacking of Traits of PIP-72 and Silencing Elements in Transgenic Plant

Transgenic plants may comprise a stack of one or more insecticidal polynucleotides disclosed herein with one or more additional polynucleotides resulting in the production or suppression of multiple insecticidal polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene or silencing element disclosed herein with a subsequent gene or silencing element and co-transformation of genes and/or silencing elements into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments one or more polynucleotide encoding the polypeptides of the PIP-72 polypeptides or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

In some embodiments polynucleotides encoding one or more of the PIP-72 polypeptides disclosed herein are stacked with one or more polynucleotides encoding pesticidal proteins disclosed herein.

In one embodiment, polynucleotides encoding one or more of the PIP-72 polypeptides disclosed herein are stacked with one or more polynucleotides encoding PIP-47 polypeptides of WO2015/023846, which is incorporated by reference in its entirety.

Gene Silencing

In some embodiments the stacked trait may be in the form of silencing of one or more polynucleotides of interest resulting in suppression of one or more target pest polypeptides. In some embodiments the silencing is achieved through the use of a silencing element.

In some embodiments the polynucleotides encoding the PIP-72 polypeptides disclosed herein are stacked with one or more silencing elements having insecticidal activity.

In some embodiments the polynucleotides encoding the PIP-72 polypeptides disclosed herein are stacked with one or more polynucleotides encoding silencing elements targeting RyanR (SEQ ID NO: 992), HP2 SEQ ID NO: 994), or RPS10 (SEQ ID NO: 995). In one embodiment, the polynucleotides encoding the PIP-72 polypeptides disclosed herein are stacked with polynucleotides encoding a silencing element disclosed in US Patent Application Publication No. US US2014/0275208 or US2015/0257389. In one embodiment, the polynucleotides encoding the PIP-72 polypeptides disclosed herein are stacked with polynucleotides encoding a silencing element comprising any one of SEQ ID NOs:

982-991, 993, or SEQ ID NOs: 561-572 of US Patent Application Publication No. US2014/0275208 and US2015/0257389.

In some embodiments the polynucleotides encoding the PIP-72 polypeptides and polynucleotides encoding silencing elements disclosed herein are stacked with one or more additional insect resistance traits.

In some embodiments the polynucleotides encoding the PIP-72 polypeptides and polynucleotides encoding silencing elements disclosed herein are to be stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Some embodiments relate to down-regulation of expression of target genes in insect pest species by interfering ribonucleic acid (RNA) molecules.

Silencing elements that may be stacked with one or more PIP-72 polynucleotides includes the following: silencing elements of the vacuolar ATPase H subunit (US Patent Application Publication 2012/0198586; insect ribosomal protein such as the ribosomal protein L19 (PCT publication 2012/0198586), the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. PCT publication WO 2007/035650 describes silencing elements directed to Snf7; US Patent Application publication 2011/0054007 describes polynucleotide silencing elements targeting RPS10; US Patent Application publication US2015/0257389 describes polynucleotide silencing elements targeting RyanR and PAT3; US Patent Application Publication 2012/0164205 describes silencing elements directed to a Chd3 Homologous Sequence, a Beta-Tubulin Homologous Sequence, a 40 kDa V-ATPase Homologous Sequence, a EF1α Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* J E Smith (fall armyworm); *S. exigua* Hübner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); *Egira (Xylomyges) curialis* Grote (citrus cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenée (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rösslerstam (summer fruit tortrix moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermüller (European grape vine moth); *Spilonota ocellana* Denis & Schiffermüller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Méneville (Chinese Oak Tussah Moth); *Bombyx mori* Linnaeus (Silkworm); *Bucculatrix thurberiella* Busck (cotton leaf perforator); *Collas eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea* Linnaeus (browntail moth); *Harrisina americana* Guérin-Méneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vemata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenée; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape colaspis); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicomis* Loew (corn blotch leafminer); midges (including, but not limited to: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other *Brachycera*, mosquitoes *Aedes* spp.; *Anopheles* spp.; *Culex* spp.; black flies *Prosimulium* spp.; *Simulium* spp.; biting midges, sand flies, sciarids, and other *Nematocera*.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, lssidae and Delphacidae, treehoppers from the family Membracidae, psyllids from the family Psyllidae, whiteflies from the family Aleyrodidae, aphids from the family Aphididae, phylloxera from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Melanaphis sacchari* (sugarcane aphid); *Adelges* spp. (adelgids); *Phylloxera devastatrix* Pergande (pecan phylloxera); *Bemisia tabaci* Gennadius (tobacco whitefly, sweetpotato whitefly); *B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Ståal (rice leafhopper); *Nilaparvata lugens* Stal (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear psylla); *Trioza diospyri* Ashmead (persimmon psylla).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schäffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; *Tinidae* spp.; *Blostomatidae* spp.; *Reduviidae* spp. and *Cimicidae* spp.

Also included are adults and larvae of the order Acari (mites) such as *Aceria tosichella* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family *Pentatomidae* (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (Bagrada Bug)), the family Plataspidae (*Megacopta cribraria*—Bean plataspid) and the family Cydnidae (*Scaptocoris castanea*—Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743, 477, all of which are herein incorporated by reference in their entirety. Generally, the protein is mixed and used in feeding assays. See, for example Marrone, et al., (1985) *J.* of *Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C. D. S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of *cereus, firmus, megaterium, pumilis, sphaericus, subtilis* and/or *thuringiensis* species), *bradyrhizobium* spp. (including one or more of *betae, canariense, elkanii, iriomotense, japonicum, liaonigense, pachyrhizi* and/or *yuanmingense*), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, penicillium, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, trichoderma, trifloxystrobin, triticonazole and/or zinc. PCNB seed coat refers to EPA Registration Number 00293500419, containing quintozen and terrazole. TCMTB refers to 2-(thiocyanomethylthio) benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest with an insecticidally-effective amount of a recombinant PIP-72 polypeptide and a polynucleotide encoding a silencing element. In some embodiments methods are provided for killing an insect pest, comprising contacting the insect pest with an insecticidally-effective amount one or more recombinant pesticidal protein(s) of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772 or SEQ ID NO: 852 or a variant thereof, and one or more silencing elements target disclosed in US Patent Application Publication No. US2014/0275208 or US2015/0257389.

In some embodiments methods are provided for controlling an insect pest population, comprising contacting the insect pest population with an insecticidally-effective amount of one or more recombinant PIP-72 polypeptide(s) and one or more polynucleotides encoding a silencing element(s). As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population with an insecticidally-effective amount of one or more recombinant PIP-72 polypeptide and a silencing element.

In some embodiments methods are provided for protecting a plant from an insect pest, comprising expressing in the plant or cell thereof a recombinant polynucleotide encoding one or more PIP-72 polypeptide and a silencing element(s).

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the PIP-72 polypeptides and a polynucleotide encoding a silencing element of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments the methods of controlling Lepidoptera and/or Coleoptera insect infestation in a transgenic plant and promoting insect resistance management comprise a PIP-72 polypeptide insecticidal and a silencing element to insects in the order Lepidoptera and/or Coleoptera.

In some embodiments the methods of controlling Lepidoptera and/or Coleoptera insect infestation in a transgenic plant and promoting insect resistance management comprise expressing in the transgenic plant a PIP-72 polypeptide and a polynucleotide encoding silencing element insecticidal to insects in the order Lepidoptera and/or Coleoptera having different modes of action.

Also provided are methods of reducing likelihood of emergence of Lepidoptera and/or Coleoptera insect resistance to transgenic plants expressing in the plants insecticidal proteins to control the insect species, comprising expression of a PIP-72 polypeptide and a polynucleotide encoding a silencing element insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise a PIP-72 polypeptide and a Cry protein. Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins.

The above description of various illustrated embodiments of the disclosure is not intended to be exhaustive or to limit the invention to the precise form disclosed. While specific embodiments, and examples, are described herein for illustrative purposes, various equivalent modifications are possible within the scope, as those skilled in the relevant art will recognize. The teachings provided herein can be applied to other purposes, other than the examples described above. The embodiments may be practiced in ways other than those particularly described in the foregoing description and examples. Numerous modifications and variations of the invention are possible in light of the above teachings and, therefore, are within the scope of the appended claims.

These and other changes may be made to the embodiments in light of the above detailed description. In general, in the following claims, the terms used should not be construed to limit the embodiments to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

EXPERIMENTALS

Example 1—Insecticidal Activity of Transgenic Plants Expressing PIP-72 and dsRNA RyanR Silencing Element Rootworms assays were performed by infesting plants which had been recently transplanted from flats into pots with a volume of approximately 3 liters. Soil mix was variable but should be high in peat, bark chunks and other soil amendments to lighten the medium and promote aeration and healthy root growth. 2 days after transplanting, plants were infested with 200 western corn rootworm eggs suspended in water. Eggs were timed so hatch would occur within a few days of infestation. Plants were maintained with standard greenhouse practices of watering and applications of fertilizer. 19 days later, plants were removed from pots and the soil washed from the roots to expose the feeding damage. Ratings were made using the Node Injury Scale developed by Nowatzki et al (2005) *J. of Economic Entomology*, 98, 1-8. The Nodal Injury Score is based on number of root nodes of damage with 0 indicating no damage and 3 indicating 3 nodes of roots are eaten to a length of less than 2 centimeters. The stacked constructs show significantly reduced feeding damage compared to the negative controls (FIG. 1).

Figure 2:
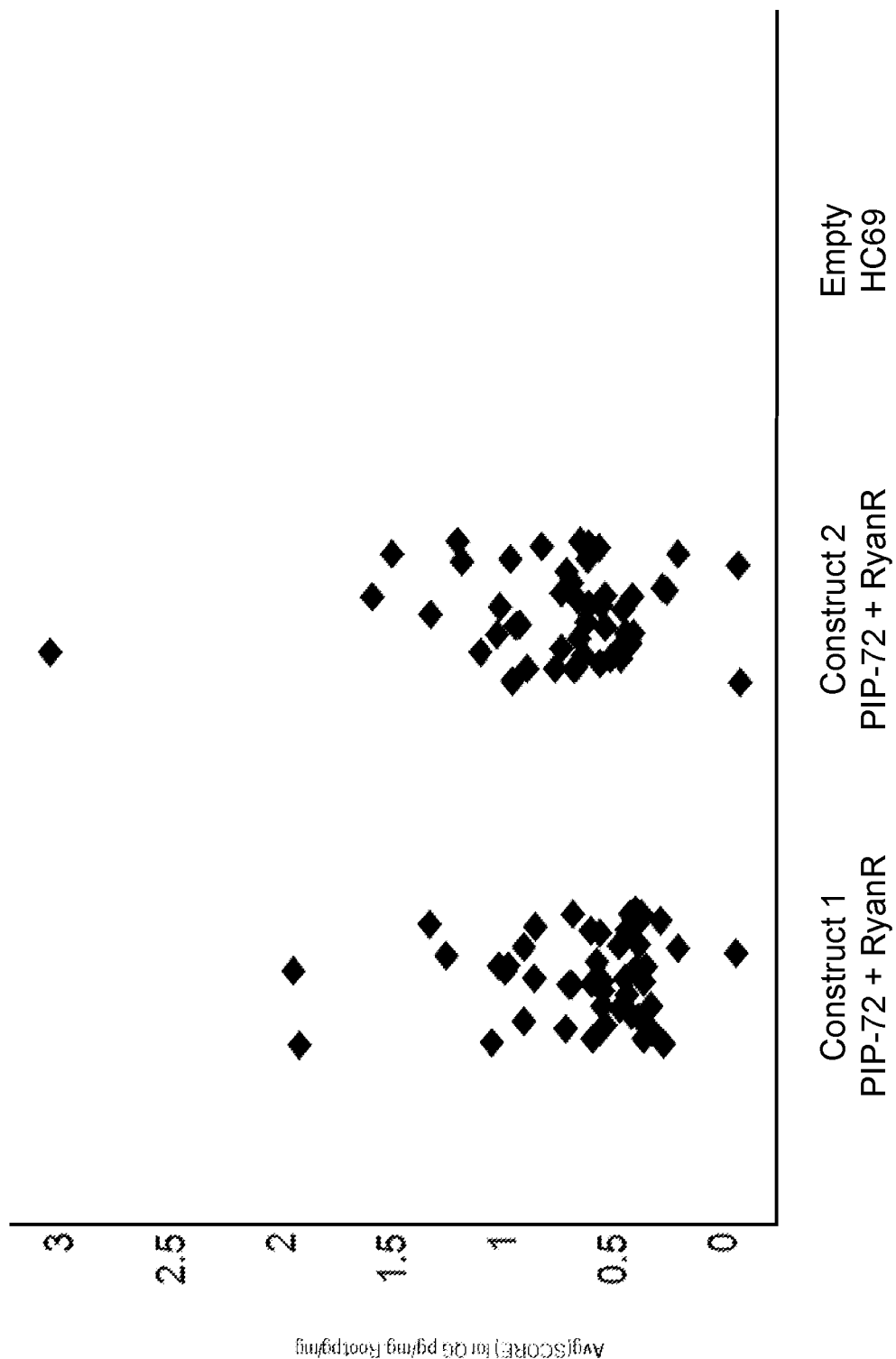
FIG. 2 shows a graph representing T0 plant expression of RyanR silencing element either as a stacked construct comprising a polynucleotide encoding a PIP-72 polypeptide and RyanR silencing element (SEQ ID NO: 993) or negative control line, HC69.

Example 2—Expression of dsRANA RyanR Silencing Element in PIP-72 and dsRNA RyanR Silencing Element Stacked Transgenic Maize QuantiGene® Plex 2.0 RNA assay (Affymetrix®) was used for detecting dsRNA targeting RyanR (DvSSJ, SEQ ID NO: 993) sense strand of transcript in transgenic plants. Double strand RNA targeting RyanR was made by In vitro transcription. Purified dsRNA was quantified by OD260 and used as standard for quantitative detection. Transgenic roots (about 45 mg) were collected from each individual T0 plant and processed for QuantiGene® detection according to the QuantiGene® 2.0 User Manual. RNA expression data were calculated as picogram per mg fresh root (or pg/mg). The stacked constructs show significant expression of dsRNA targeting RyanR, with no detection in a negative control (FIG. 2).

Example 3—Expression of PIP-72 Polypeptide in PIP-72 and dsRNA RyanR Silencing Element Stacked Transgenic Maize The absolute expression concentration of PIP-72Aa protein was determined by using LC-MS/MS (liquid chromatography coupled with tandem mass spectrometry) according J Agric Food Chem. 2011 Apr. 27; 59(8):3551-8). After being lyophilized and ground, 10 mg of leaf samples were extracted with 600 µl PBST buffer (phosphate-buffered saline and 0.05% Tween 20). Approximately 500 mg of fresh frozen root samples were extracted with 1000 µl PBST buffer. After centrifugation, the supernatant was collected and total extracted proteins (TEPs) were measured with a Bradford assay. Samples were normalized by TEP. A total of 50 µL of the normalized extract was added to 100 µL of digestion buffer ABCT (100 mM ammonium bicarbonate and 0.05% Tween 20). A standard curve was prepared by spiking different amounts of the recombinant protein standard into 50 µL aliquots of negative sample extract. An appropriate amount of the digestion buffer ABCT was added to each point of the standard curve to keep total volumes consistent among samples and standards. Samples and standards were reduced with 6 µL of 0.25 M dithiothreitol at 50° C. for 30 min and then alkylated with 6 µL of 0.3 M iodoacetamide at room temperature in the dark for 30 min. One µg of trypsin (10 µL) was added to each sample and digestion was allowed to proceed at 37° C. overnight (~18 hours) before 10 µL 10% (v/v) formic acid was added. PIP-72Aa protein was quantified by monitoring its signature tryptic peptide QETWDR with MRM (multiple reaction monitoring) transition of 417.7/577.3, using a Waters UPLC (ultra-performance liquid chromatography) coupled with AB SCIEX Q-TRAP 5500. Autosampler temperature was maintained at 8° C. during analysis. 10 µL volumes were injected onto an BEH 50×2.1 mm 1.7µ C18 column (Waters) maintained at 60° C. Mobile phases consisted of 0.1% formic acid (MPA) and 0.1% formic acid in acetonitrile (MPB), and LC was performed at a flow rate of 1.0 mL/min with linear gradient of 2-10% MPB in 1.5 min. Protein concentrations in the unknown samples were calculated by interpolation into the standard curve using Analyst version 1.6.2 software (AB Sciex). The stacked constructs show significant expression of PIP-72, with no detection in a negative control (FIG. 3).

Example 4—Agrobacterium-Mediated StableTransformation of Maize

For Agrobacterium-mediated maize transformation of PIP-72 and dsRNA RyanR silencing element stacked transgenic maize, the method of Zhao was employed (U.S. Pat. No. 5,981,840 and International Patent Publication Number WO 1998/32326). Briefly, immature embryos were isolated from maize and the embryos contacted with an Agrobacterium Suspension, where the bacteria were capable of transferring a polynucleotide encoding a PIP-72 polypeptide and a polynucleotide encoding a silencing element targeting RyanR to at least one cell of at least one of the immature embryos (step 1: the infection step). In this step the immature embryos were immersed in an Agrobacterium suspension for the initiation of inoculation. The embryos were co-cultured for a time with the Agrobacterium (step 2: the co-cultivation step). The immature embryos were cultured on solid medium with antibiotic, but without a selecting agent, for Agrobacterium elimination and for a resting phase for the infected cells. Next, inoculated embryos were cultured on medium containing a selective agent and growing transformed callus is recovered (step 4: the selection step). The immature embryos were cultured on solid medium with a selective agent resulting in the selective growth of transformed cells. The callus was then regenerated into plants (step 5: the regeneration step), and calli grown on selective medium were cultured on solid medium to regenerate the plants.

Transgenic maize plants positive for expression of the insecticidal proteins are tested for pesticidal activity using standard bioassays known in the art. Such methods include, for example, root excision bioassays and whole plant bioassays. See, e.g., US Patent Application Publication Number US 2003/0120054 and International Publication Number WO 2003/018810.

SEQUENCE LISTING (995 sequences)

SEQ ID NO: 1 - DNA, 261 bp, Pseudomonas chlororaphis
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 2 - protein, 86 aa, Pseudomonas chlororaphis
MGITVTNNSSNPIEVAINHWGSDGDTSFFSVGNGKQETWDRSDSRGFVLSLKKNGAQHPYYVQASSKIEVDNNAVKDQGRLIEPLS

SEQ ID NO: 3 - DNA, 261 bp, Pseudomonas rhodesiae
atgggtattactgttaaaaacaattcatccaacacaattgaagttgcagtcaaccattggggaaaagatggggatacaagcttcttctcaatcgctaacggcaagcaggaaagctgggacaggtctgacagtcgcggctttgtactctccttaaagagaaatggagcacaacacccatactatgttcaggccagtagccaaattgaagttgaccataacgcagtgaaggatcatggcgagcctattcacccgctctcgtaa

SEQ ID NO: 4 - protein, 86 aa, Pseudomonas rhodesiae
MGITVKNNSSNTIEVAVNHWGKDGDTSFFSIANGKQESWDRSDSRGFVLSLKRNGAQHPYYVQASSQIEVDHNAVKDHGEPIHPLS

SEQ ID NO: 5 - DNA, 261 bp, Pseudomonas chlororaphis
atgggtattaccgttaccaacaaatcatcgaaaaagattgaagtctcgatcaacaaatggggcagcgacggcgacaccaccttctttggagtcgacagcggcaagcaggaaagctgggaccgatcggacgaccgtggctttgtgctgtccctgaaaagaaacggcacccaggcgccttactatgtacaggcaacgagcaagatcgaagttgatagcagcaccgtgaaagaccacggtgagactattcacccggtcgcctga

SEQ ID NO: 6 - protein, 86 aa, Pseudomonas chlororaphis
MGITVTNKSSKKIEVSINKWGSDGDTTFFGVDSGKQESWDRSDDRGFVLSLKRNGTQAPYYVQATSKIEVDSSTVKDHGETIHPVA

SEQ ID NO: 7 - DNA, 261 bp, Pseudomonas mandelii
atgggtattaccgttaccaacaaatcatcgaaaaagattgaagtctcggtcaacaaatggggcagcgacggcgacaccaccttctttggaatcgacagcggcaagcaggaaagctgggacagatcggacgaccgtggctttgtgctgtccctgaaaaggaacggcacccaggcgccttactatgtccaggccacgagcaagatcgaagttgatagcagcaccgtgaaagaccacggtgagactattcacccggtcgcctaa

SEQ ID NO: 8 - protein, 86 aa, Pseudomonas mandelii
MGITVTNKSSKKIEVSVNKWGSDGDTTFFGIDSGKQESWDRSDDRGFVLSLKRNGTQAPYYVQATSKIEVDSSTVKDHGETIHPVA

SEQ ID NO: 9 - DNA, 258 bp, Pseudomonas congelans
atgggtattaccgttaccaacaaatcatcgaaaaaaattgaagcctcgatcaacaaatggggtagcgacggcgacaccaagttcttcggaatcgatagcggcaagcaggaaagctgggaccgatcagacgaccgtggctttgtgctgtcactgaaaaggaacggcacccaggcgccttactatgtacaggccacgagcaagatcgaaattgaaaacagtacggtgaaagaccacggtgaaaccattcacccggtcgcg

SEQ ID NO: 10 - protein, 86 aa, Pseudomonas congelans
MGITVTNKSSKKIEASINKWGSDGDTKFFGIDSGKQESWDRSDDRGFVLSLKRNGTQAPYYVQATSKIEIENSTVKDHGETIHPVA

SEQ ID NO: 11 - DNA, 261 bp, Pseudomonas mandelii
atgggtattaccgttaccaacaaatcatcgaaaaaaattgaagcctcgatcaacaaatggggtagcgacggcgacaccaaattcttcggaatcgatagcggcaagcaggaaagctgggacagatcagacgatcgcggctttgtgctatccctgaaaaggaacggcacccaggcgccttactatgtacaggccacgagcaagatcgaagttgaaaacagtatggtgaaagaccacggcgaaactattcacccggtcgcgtaa

SEQ ID NO: 12 - protein, 86 aa, Pseudomonas mandelii
MGITVTNKSSKKIEASINKWGSDGDTKFFGIDSGKQESWDRSDDRGFVLSLKRNGTQAPYYVQATSKIEVENSMVKDHGETIHPVA

SEQ ID NO: 13 - DNA, 261 bp, Pseudomonas ficuserectae
atgggtattaccgttaccaacaaatcatcgaaaaaaattgaagcctcgatcaacaaatggggtagcgacggcgacaccaagttcttcggaatcgatagcggcaagcaggaaagctgggaccgatcagacgaccgtggctttgtgctgtcactgaaaaggaacggcacccaggcgccttactatgtacaggccacgagcaagatcgaaattgaaaacagtgcggtgaaagaccacggtgaaaccattcacccggtcgcgtaa

SEQ ID NO: 14 - protein, 86 aa, Pseudomonas ficuserectae
MGITVTNKSSKKIEASINKWGSDGDTKFFGIDSGKQESWDRSDDRGFVLSLKRNGTQAPYYVQATSKIEIENSAVKDHGETIHPVA

SEQ ID NO: 15 - DNA, 264 bp, Pseudomonas congelans
atgagcattaccgttaaaaataacacctcgaatataattgaagttgccattaaccaatgggacacggacggcgacactcgttactctccgctcgctgcgggagcatcagataagtgggttagaaaggacagtagaggatatgttctttcactaagacaaggaggtactgaaaagccatattacgtactggttgacagcaacattgtggttgccaacactgaggtaaaagacaacgatacggttatttctccaatcagtagataa

SEQ ID NO: 16 - protein, 87 aa, Pseudomonas congelans
MSITVKNNTSNIIEVAINQWDTDGDTRYSPLAAGASDKWVRKDSRGYVLSLRQGGTEKPYYVLVDSNIVVANTEVKDNDTVISPISR

SEQ ID NO: 17 - DNA, 273 bp, Pseudomonas mosselii
atgaagctcacgatcaccaatggcgcaagcacatcgattgacattgcagtgagtgcatggcgtaacgacggcaatgacagttactactcgatagctcaaggggaatctgatacctgggaccgcagcgacgcaagagggtacttgatggcggtaaaaatgaaatcccaggtaaaaacctactacatatcccaaaccagcaagatagttgttgaagacaacattgttaaagaccacggccaaacccttaacccgctatacgcagtaaacaacatg

SEQ ID NO: 18 - protein, 91 aa, Pseudomonas mosselii
MKLTITNGASTSIDIAVSAWRNDGNDSYYSIAQGESDTWDRSDARGYLMAVKMKSQVKTYYISQTSKIVVEDNIVKDHGQTLNPLYAVNNM

SEQ ID NO: 19 - DNA, 273 bp, Burkholderia pseudomallei
atggcgataagcgtcaaaaacagcgcatcgaacacggttgaagtgtcgatcaatcactggggaacggacggagacaccaagccgttcaagatggcgcccggagccagcgattcctgggatcgcaacgacctacgtggcttcgtcatgtatgtgcagctgggcgggtcggcgacgccgtactatgtgctgagcaccagtaatatcgtgatctacgacgacaaggtgacggatagcgggcaaacgctccttcccgcaaacaagcgttttggctga

SEQ ID NO: 20 - protein, 90 aa, Burkholderia pseudomallei
MAISVKNSASNTVEVSINHWGTDGDTKPFKMAPGASDSWDRNDLRGFVMYVQLGGSATPYYVLSTSNIVIYDDKVTDSGQTLLPANKRFG

SEQ ID NO: 21 - DNA, 270 bp, unknown
  encodes Hypothetical Protein from Switchgrass rhizosphere
atgagcatcacaatcacaaacggagcaagcagacagtccaaattgcagtcagcgtatgggggcgagacggtagtgacgattattattcactagagcccggcaaaggtgatacatggggacgtaatgacccaagaggttacttgatggccataaaggccaacccaagcaggtgtatattacgtcgcctttgacagtcaaattgtcatagaagacaaccttgtaaaggatcgcggccgaactatcaacccactcgcttcgaataatcaataa

SEQ ID NO: 22 - protein, 89 aa, unknown
  Hypothetical Protein from Switchgrass rhizosphere
MSITITNGASQTVQIAVSVWGRDGSDDYYSLEPGKGDTWGRNDPRGYLMAIKANPAGVYYVAFDSQIVIEDNLVKDRGRTINPLASNNQ

SEQ ID NO: 23 - DNA, 297 bp, unknown
  encodes Hypothetical Protein from Switchgrass rhizosphere
atgaacatgagcatcacagtcaccaacggggcaagcacagtagttaacgtggcaatcagtacatgggaaaaagacggcagtgacgcttactggccattagagcaaggcaaaggtgatacctggaaacgtagtgacccaaggggttacttgatggccatacaggataaatcccaaacaactgaatactacgtcacctgcaacagtgtaattgtcatcgaagacaacctcgtgaaggatcacggccggactcttaacccactcgccgcggccgggaagaaaaatgtggtaaatgcgtaa

SEQ ID NO: 24 - protein, 98 aa, unknown
  Hypothetical Protein from Switchgrass rhizosphere
MNMSITVTNGASTVVNVAISTWEKDGSDAYWPLEQGKGDTWKRSDPRGYLMAIQDKSQTTEYYVTCNSVIVIEDNLVKDHGRTLNPLAAAGKKNVVNA

SEQ ID NO: 25 - DNA, 273 bp, unknown
  Hypothetical Protein from Switchgrass rhizosphere
atgagcatcacaatcacaaacggagcaagcagaacagtccaaattgcagtcagcgtatgggggcgagacggtagtgacgattattattcactagagcccggcaaaggtgatacatggggacgtaatgacccaagaggttacttgatggccataaaaggccaaacccaagcaggtgtatattacgtcgcctttgacagtcaaattgtcatagaagacaaccttgtaaaggatcgcggccgaactatcaacccactcgcttcgaataatcaataa

SEQ ID NO: 26 - protein, 90 aa, unknown
  Hypothetical Protein from Switchgrass rhizosphere
MSITITNGASRTVQIAVSVWGRDGSDDYYSLEPGKGDTWGRNDPRGYLMAIKGQTQAGVYYVAFDSQIVIEDNLVKDRGRTINPLASNNQ

SEQ ID NO: 27 - DNA, 297 bp, Pseudomonas chlororaphis
atgaacatgagcatcacagtcacaaacggtgcaagcgcagtagttaaagtagccattagcacatggcagaaagacggcaatgacgatttctggtcattagatcaaggcgcaagcgatacctggaaacgtagcgacccaaggggctacttgatggccgtacaagacaagtcccgcacaactgaatactacgtttcctgcaacagcgccatcgttatcgaagacaatctcgtcaaagatcacggtcgaactcttaacccactcattgcggccgggcagaagaacgtggctaatgcgtaa

SEQ ID NO: 28 - protein, 98 aa, Pseudomonas chlororaphis
MNMSITVTNGASAVVKVAISTWQKDGNDDFWSLDQGASDTWKRSDPRGYLMAVQDKSRTTEYYVSCNSAIVIEDNLVKDHGRTLNPLIAAGQKNVANA

SEQ ID NO: 29 - DNA, 309 bp, Pseudomonas protegens
atggaacaatcaatccaaaaaaggaatataaatatgagcatatctatcacgaacgcaggaagcagagagatccaagttgcagtcagtacttggagcacagatagcgacatcagtgatgcctattactctctggcacccgacaagggtgacaaatggaaacgtaacgacccaagaggttacttaatgactgtaaaaggccaatcccaacaaggcgtatattacgttgcctttgacagcgaaattttcatagaagacagccttgtaaaggatcgcggaaaaactatcaccaagctcgcgctggaagttcaa

SEQ ID NO: 30 - protein, 92 aa, Pseudomonas protegens
MSISITNAGSREIQVAVSTWSTDSDISDAYYSLAPDKGDKWKRNDPRGYLMTVKGQSQQGVYYVAFDSEIFIEDSLVKDRGKTITKLALEVQ

SEQ ID NO: 31 - DNA, 288 bp, Pseudomonas chlororaphis
atgagcatcacagtcacaaacggggcaagcacagtagttaacgtggcaatcagcacatgggagaaagacggcagtgacgcttactacccattagagcaaggcaacggtgacacctggaaacgtagtgacccaaggggttacttgatggccatacaggataagtcccaaacaactgaatactacgtcacctgcaacagtgtaattgtcatcgaagacaacctcgtgaaggatcacggccgaactcttaacccagtcgctgcggccgggaagagaaaagtggcaaatgcg

SEQ ID NO: 32 - protein, 96 aa, Pseudomonas chlororaphis
MSITVTNGASTVVNVAISTWEKDGSDAYYPLEQGNGDTWKRSDPRGYLMAIQDKSQTTEYYVTCNSVIVIEDNLVKDHGRTLNPVAAAGKRKVANA

SEQ ID NO: 33 - DNA, 267 bp, Xenorhabdus bovienii
atgaagataataaataatacacaaagtaatatcatagtttctgttaataaatggggcgatgatggacaaacgggtcggtttacggtatcacctggcagaagtggatcatggaatcgcactgatgagcgcggttttgtcatggcaatactgaaaaaaggtgtacaagattccttttatattttttctgatagtgacatcaaggttttcgacagttatgttactgataatggcagaagaatcaaacccgcaactgaccgatattattag

SEQ ID NO: 34 - protein, 88 aa, Xenorhabdus bovienii
MKIINNTQSNIIVSVNKWGDDGQTGRFTVSPGRSGSWNRTDERGFVMAILKKGVQDSFYIFSDSDIKVFDSYVTDNGRRIKPATDRYY

SEQ ID NO: 35 - DNA, 282 bp, Photorhabdus luminescens
atgattattgttaaaaattcttcaaataaggtgactaaagtttcaattaataagtgggggaaagatggtaatacaggttattgggatattaatccgggagatacagcgagttggaatcgcactgatggtcgtggttttgtaatgtcaataatacgtgagaatgaggaccaaaagtcatattttgtcttagcaaatagcaacattgttatttatgataaagatgctactggttacggtaaaaatgttcaggataatggtcgttggatatatcctttaaattga

SEQ ID NO: 36 - protein, 93 aa, Photorhabdus luminescens
MIIVKNSSNKVTKVSINKWGKDGNTGYWDINPGDTASWNRTDGRGFVMSIIRENEDQKSYFVLANSNIVIYDKDATGYGKNVQDNGRWIYPLN

SEQ ID NO: 37 - DNA, 297 bp, Pseudomonas chlororaphis
atgaacatgagcatcacagtcacaaacggagcaagcgcagtagttaacgtggcaatcagcacatgggagaaagacggcagtgacgcttactacccattagagcaaggcagcggtgacacctggaaacgtagtgacccaaggggttacttgatggccatacaggataaatcccaaacaactgaatactacgtctcctgcaacagtgcaattgtcatcgaagacaacctcgtaaaggatcacggccgaactcttaacccagtcgctgcggccgggaagaaaaaagtggcaaatgcgtaa

SEQ ID NO: 38 - protein, 98 aa, Pseudomonas chlororaphis
MNMSITVTNGASAVVNVAISTWEKDGSDAYYPLEQGSGDTWKRSDPRGYLMAIQDKSQTTEYYVSCNSAIVIEDNLVKDHGRTLNPVAAAGKKKVANA

SEQ ID NO: 39 - DNA, 40 bp, Artificial Sequence
  cloning primer
atatatgcatgcatatgggtattaccgttacaaacaattc

SEQ ID NO: 40 - DNA, 31 bp, Artificial Sequence
  cloning primer
aaggatccttacgagagcggctcgatcaacc

SEQ ID NO: 41 - DNA, 39 bp, Artificial Sequence
  cloning primer
gggaaacatatgggtattactgttaaaaacaattcatcc

SEQ ID NO: 42 - DNA, 34 bp, Artificial Sequence
  cloning primer
tttcccggatccttacgagagcggcagcaatgtc

SEQ ID NO: 43 - DNA, 34 bp, Artificial Sequence
  cloning primer
ttattcatatgggtattaccgttaccaacaaatc

SEQ ID NO: 44 - DNA, 35 bp, Artificial Sequence
  cloning primer
aaggatcctcaggcgaccgggtgaatagtctcacc

SEQ ID NO: 45 - DNA, 34 bp, Artificial Sequence; identical to SEQ ID NO: 43
  cloning primer

SEQ ID NO: 46 - DNA, 35 bp, Artificial Sequence; identical to SEQ ID NO: 44
  cloning primer

SEQ ID NO: 47 - DNA, 34 bp, Artificial Sequence
  cloning primer
atcatcatatgggtattaccgttaccaacaaatc

SEQ ID NO: 48 - DNA, 34 bp, Artificial Sequence
  cloning primer
aaggatccttacgcgaccgggtgaatggtttcac

SEQ ID NO: 49 - DNA, 34 bp, Artificial Sequence; identical to SEQ ID NO: 43
  cloning primer

SEQ ID NO: 50 - DNA, 36 bp, Artificial Sequence
  cloning primer
aaggatccttacgcgaccgggtgaatggtttcaccg

SEQ ID NO: 51 - DNA, 37 bp, Artificial Sequence
  cloning primer
ttattcatatgggtattaccgttaccaacaaatcatc

SEQ ID NO: 52 - DNA, 35 bp, Artificial Sequence
  cloning primer
aaggatccttacgcgaccgggtgaatagtttcgcc

SEQ ID NO: 53 - DNA, 36 bp, Artificial Sequence
  cloning primer
gggaaacatatgagcattaccgttaaaaataacacc

SEQ ID NO: 54 - DNA, 38 bp, Artificial Sequence
  cloning primer
tttcccggatccttatctactgattggagaaataaccg

SEQ ID NO: 55 - DNA, 31 bp, Artificial Sequence
  cloning primer
atcatcatatgaagctcacgatcaccaatgg

SEQ ID NO: 56 - DNA, 34 bp, Artificial Sequence
  cloning primer
ttggatccttacatgttgtttactgcgtatagcg

SEQ ID NO: 57 - DNA, 35 bp, Artificial Sequence
  cloning primer
gagatcatatgaacatgagcatcacagtcaccaac

SEQ ID NO: 58 - DNA, 37 bp, Artificial Sequence
  cloning primer
gtcttggatccttacgcatttaccacatttttcttcc

SEQ ID NO: 59 - DNA, 36 bp, Artificial Sequence
  cloning primer
gagatcatatgaacatgagcatcacagtcacaaacg

SEQ ID NO: 60 - DNA, 37 bp, Artificial Sequence
  cloning primer
gtcttggatccttacgcattagccacgttcttctgcc

SEQ ID NO: 61 - DNA, 32 bp, Artificial Sequence
  cloning primer
aataacatatggaacaatcaatccaaaaaagg

SEQ ID NO: 62 - DNA, 34 bp, Artificial Sequence
  cloning primer
aaggatccttattgaacttccagcgcgagcttgg

SEQ ID NO: 63 - DNA, 30 bp, Artificial Sequence
  cloning primer
cagaacatatgagcatcacagtcacaaacg

SEQ ID NO: 64 - DNA, 34 bp, Artificial Sequence
  cloning primer
ttggatccttacgcatttgccacttttctcttcc

SEQ ID NO: 65 - DNA, 36 bp, Artificial Sequence; identical to SEQ ID NO: 59
  cloning primer

SEQ ID NO: 66 - DNA, 37 bp, Artificial Sequence
  cloning primer
gtcttggatccttacgcatttgccacttttttcttcc

SEQ ID NO: 67 - DNA, 33 bp, Artificial Sequence
  cloning primer
ttattcatatgagcatcacagtcacaaacggag

SEQ ID NO: 68 - DNA, 34 bp, Artificial Sequence
  cloning primer
aaggatccttacgcatttgccacttttttcttcc

SEQ ID NO: 69 - DNA, 24 bp, Artificial Sequence
  mutagenesis primer
aagcttgaattcggatccttacga

SEQ ID NO: 70 - DNA, 60 bp, Artificial Sequence
  mutagenesis primer
atcgaaggtaggcatatggcgatttctgttaaaaacaatgcgtccaaccccgtcgaagtc

SEQ ID NO: 71 - DNA, 60 bp, Artificial Sequence
  mutagenesis primer
gccatcaatcattggggtacagacggagacaccaaaccgttttccgtcgcgccgggcgcc

SEQ ID NO: 72 - DNA, 60 bp, Artificial Sequence
  mutagenesis primer
tccgatagctgggacaggaacgaccttcgtggcttcgtgatgtatgttcaactgggcggc

SEQ ID NO: 73 - DNA, 60 bp, Artificial Sequence
  mutagenesis primer
tccgcacacccttactacgttctgagcaccagcaacattgtgatctatgacgataaagtg

SEQ ID NO: 74 - DNA, 54 bp, Artificial Sequence
  mutagenesis primer
accgattcgggccaaactcttctgccgctctcgtaaggatccgaattcaagctt

SEQ ID NO: 75 - DNA, 60 bp, Artificial Sequence
  mutagenesis primer
gtctccgtctgtaccccaatgattgatggcgacttcgacggggttggacgcattgttttt

SEQ ID NO: 76 - DNA, 60 bp, Artificial Sequence
  mutagenesis primer
acgaaggtcgttcctgtcccagctatcggaggcgcccggcgcgacggaaaacggtttggt

SEQ ID NO: 77 - DNA, 60 bp, Artificial Sequence
  mutagenesis primer
ggtgctcagaacgtagtaagggtgtgcggagccgcccagttgaacatacatcacgaagcc

SEQ ID NO: 78 - DNA, 60 bp, Artificial Sequence
  mutagenesis primer
gagcggcagaagagtttggcccgaatcggtcactttatcgtcatagatcacaatgttgct

SEQ ID NO: 79 - DNA, 60 bp, Artificial Sequence
  mutagenesis primer
  misc_feature (20)..(20): S is G or C
  misc_feature (20)..(20): s is g or c
atcgaaggtaggcatatggscattagcgttaaaaacagcgcatccaacacggtcgaagtc

SEQ ID NO: 80 - DNA, 60 bp, Artificial Sequence
  mutagenesis primer
  misc_feature (1)..(1): k is g or t
  misc_feature (50)..(50): s is g or c
kcaatcaatcattggggtactgacggagacaccaaaccgtttaaaatggscccgggcgct

SEQ ID NO: 81 - DNA, 60 bp, Artificial Sequence
  mutagenesis primer
  misc_feature (7)..(7): w is a or t
  misc_feature (40)..(40): m is a or c
agcgatwcttgggacaggaacgaccttcgtggcttcgtgmtgtacgtgcaactggggggc

SEQ ID NO: 82 - DNA, 60 bp, Artificial Sequence
  mutagenesis primer
  misc_feature (1)..(1): k is g or t
  misc_feature (28)..(28): w is a or t
kcagcgactccttactacgttcttagcwctagcaatattgtcatttacgatgataaagtg

SEQ ID NO: 83 - DNA, 54 bp, Artificial Sequence
  mutagenesis primer
acagatagcggccagacactgctgccgctctcgtaaggatccgaattcaagctt

SEQ ID NO: 84 - DNA, 60 bp, Artificial Sequence
  mutagenesis primer
  misc_feature (30)..(30): m is a or c
gtctccgtcagtaccccaatgattgattgmgacttcgaccgtgttggatgcgctgttttt

SEQ ID NO: 85 - DNA, 60 bp, Artificial Sequence
  mutagenesis primer
acgaaggtcgttcctgtcccaagwatcgctagcgcccgggsccattttaaacggtttggt

SEQ ID NO: 86 - DNA, 60 bp, Artificial Sequence
  mutagenesis primer
  misc_feature (3)..(3): w is a or t
  misc_feature (30)..(30): m is a or c
  misc_feature (51)..(51): k is g or t
agwgctaagaacgtagtaaggagtcgctgmgccccccagttgcacgtacakcacgaagcc

SEQ ID NO: 87 - DNA, 60 bp, Artificial Sequence
  mutagenesis primer
gagcggcagcagtgtctggccgctatctgtcactttatcatcgtaaatgacaatattgct

SEQ ID NO: 88 - DNA, 60 bp, Artificial Sequence
  mutagenesis primer
  misc_feature (20)..(20): s is g or c
  misc_feature (26)..(26): s is g or c
  misc_feature (52)..(52): r is a or g
atcgaaggtaggcatatggscattastgttaaaaacagcgcgtccaacactrttgaagtc

SEQ ID NO: 89 - DNA, 60 bp, Artificial Sequence
  mutagenesis primer
  misc_feature (1)..(1): k is g or t
  misc_feature (20)..(20): s is g or c
  misc_feature (246)..(46): r is a or g
kcgatcaatcattggggtastgacggagacaccaagccgtttaaartggctccaggcgcc

SEQ ID NO: 90 - DNA, 60 bp, Artificial Sequence
  mutagenesis primer
  misc_feature (6)..(6): w is a or t
  misc_feature (8)..(8): s is g or c
  misc_feature (40)..(40): w is a or t
  misc_feature (46)..(46): s is g or c
agtgawasttgggacaggaacgacttacgtggcttcgtgwtgtacstgcagctgggtggc

SEQ ID NO: 91 - DNA, 60 bp, Artificial Sequence
  mutagenesis primer
  misc_feature (1)..(1): k is g or t
  misc_feature (29)..(29): s is g or c
  misc_feature (43)..(43): r is a or g
kcggctaccccttactacgttttgtcaastagcaacattgtcrtttacgatgataaagtg

SEQ ID NO: 92 - DNA, 54 bp, Artificial Sequence
  mutagenesis primer
  misc_feature (14)..(14): r is a or g
  misc_feature (19)..(19): m is a or c
accgatagtggccrgacgmttttgccgctctcgtaaggatccgaattcaagctt

SEQ ID NO: 93 - DNA, 60 bp, Artificial Sequence
  mutagenesis primer
  misc_feature (11)..(11): s is g or c
  misc_feature (30)..(30): m is a or c
  misc_feature (38)..(38): y is c or t
gtctccgtcastaccccaatgattgatcgmgacttcaayagtgttggacgcgctgttttt

SEQ ID NO: 94 - DNA, 60 bp, Artificial Sequence
  mutagenesis primer
acgtaagtcgttcctgtcccaastwtcactggcgcctggagccaytttaaacggcttggt

SEQ ID NO: 95 - DNA, 60 bp, Artificial Sequence
  mutagenesis primer
  misc_feature (2)..(2): s is g or c
  misc_feature (30)..(30): m is a or c
  misc_feature (45)..(45): s is g or c
  misc_feature (51)..(51): w is a or t
asttgacaaaacgtagtaaggggtagccgmgccacccagctgcasgtacawcacgaagcc

SEQ ID NO: 96 - DNA, 60 bp, Artificial Sequence
  mutagenesis primer
  misc_feature (12)..(12): k is g or t
  misc_feature (17)..(17): y is c or t
  misc_feature (47)..(47): y is c or t
gagcggcaaaakcgtcyggccactatcggtcactttatcatcgtaaaygacaatgttgct

SEQ ID NO: 97 - DNA, 60 bp, Artificial Sequence
  mutagenesis primer
atcgaaggtaggcatatggcaatttcagttacaaacaatgcgtccaaccccgtggaagtc

SEQ ID NO: 98 - DNA, 60 bp, Artificial Sequence
  mutagenesis primer
gccatcaatcattggggtacggacggagacaccagcttcttttccgtcgcaaacggcaag

SEQ ID NO: 99 - DNA, 60 bp, Artificial Sequence
  mutagenesis primer
caggactcttgggacaggtccgacctgcgtggcttcgtgatgtccgtgcagaagaatggc

SEQ ID NO: 100 - DNA, 60 bp, Artificial Sequence
  mutagenesis primer
gcgcaacacccttactacgttctttccaccagcaatattgtcatttatgatgacaaggtg

SEQ ID NO: 101 - DNA, 54 bp, Artificial Sequence
  mutagenesis primer
acggattccggccagacattgctgccgctctcgtaaggatccgaattcaagctt

SEQ ID NO: 102 - DNA, 60 bp, Artificial Sequence
  mutagenesis primer
gtctccgtccgtaccccaatgattgatggcgacttccacggggttggacgcattgtttgt

SEQ ID NO: 103 - DNA, 60 bp, Artificial Sequence
  mutagenesis primer
acgcaggtcggacctgtcccaagagtcctgcttgccgtttgcgacggaaaagaagctggt

SEQ ID NO: 104 - DNA, 60 bp, Artificial Sequence
  mutagenesis primer
ggtggaaagaacgtagtaagggtgttgcgcgccattcttctgcacggacatcacgaagcc

SEQ ID NO: 105 - DNA, 60 bp, Artificial Sequence
  mutagenesis primer
gagcggcagcaatgtctggccggaatccgtcaccttgtcatcataaatgacaatattgct

SEQ ID NO: 106 - DNA, 60 bp, Artificial Sequence
  mutagenesis primer
  misc_feature (32)..(32): m is a or c
  misc_feature (49)..(49): m is a or c
atcgaaggtaggcatatggcaattagtgttamaaacartgcctccaacmctgtggaagtc

SEQ ID NO: 107 - DNA, 60 bp, Artificial Sequence
  mutagenesis primer
gccatcaatcattggggtactgacggagacaccagcttctttaaggtcgccaatggcgct

SEQ ID NO: 108 - DNA, 60 bp, Artificial Sequence
  mutagenesis primer
gccatcaatcattggggtactgacggagacaccagcttctttaaggtcgccccgggcgct

SEQ ID NO: 109 - DNA, 60 bp, Artificial Sequence
  mutagenesis primer
gccatcaatcattggggtactgacggagacaccagcccatttaaggtcgccaatggcgct

SEQ ID NO: 110 - DNA, 60 bp, Artificial Sequence
  mutagenesis primer
gccatcaatcattggggtactgacggagacaccagcccatttaaggtcgccccgggcgct

SEQ ID NO: 111 - DNA, 60 bp, Artificial Sequence
  mutagenesis primer
  misc_feature (8)..(8): s is g or c
  misc_feature (20)..(20): r is a or g
  misc_feature (26)..(26): y is c or t
  misc_feature (44)..(44): m is a or c
tcggatasctgggacaggarcgactyacgtggcttcgtgatgtmtgtacaattaaatggc

SEQ ID NO: 112 - DNA, 60 bp, Artificial Sequence
  mutagenesis primer
  misc_feature (8)..(8): s is g or c
  misc_feature (20)..(20): r is a or g
  misc_feature (26)..(26): y is c or t
  misc_feature (44)..(44): m is a or c
tcggatasctgggacaggarcgactyacgtggcttcgtgatgtmtgtacaattagggggc

SEQ ID NO: 113 - DNA, 60 bp, Artificial Sequence
  mutagenesis primer
  misc_feature (8)..(8): s is g or c
  misc_feature (20)..(20): r is a or g
  misc_feature (26)..(26): y is c or t
  misc_feature (44)..(44): m is a or c
tcggatasctgggacaggarcgactyacgtggcttcgtgatgtmtgtacaaaaaaatggc

SEQ ID NO: 114 - DNA, 60 bp, Artificial Sequence
  mutagenesis primer
  misc_feature (8)..(8): s is g or c
  misc_feature (20)..(20): r is a or g
  misc_feature (26)..(26): y is c or t
  misc_feature (44)..(44): m is a or c
tcggatasctgggacaggarcgactyacgtggcttcgtgatgtmtgtacaaaaagggggc

SEQ ID NO: 115 - DNA, 60 bp, Artificial Sequence
  mutagenesis primer
tctgcacacccttactacgttcwgtctaccagcaawattgwaatckacracracgccgtg

SEQ ID NO: 116 - DNA, 60 bp, Artificial Sequence
  mutagenesis primer
tctcagcacccttactacgttcwgtctaccagcaawattgwaatckacracracgccgtg

SEQ ID NO: 117 - DNA, 54 bp, Artificial Sequence
  mutagenesis primer
  misc_feature (2)..(2): m is a or c
amagattctggccagacccttttaccgctctcgtaaggatccgaattcaagctt

SEQ ID NO: 118 - DNA, 54 bp, Artificial Sequence
  mutagenesis primer
  misc_feature (2)..(2): m is a or c
amagatcaaggccagacccttttaccgctctcgtaaggatccgaattcaagctt

SEQ ID NO: 119 - DNA, 60 bp, Artificial Sequence
  mutagenesis primer
  misc_feature (42)..(42): k is g or t
  misc_feature (53)..(53): y is c or t
  misc_feature (59)..(59): k is g or t
gtctccgtcagtaccccaatgattgatggcgacttccacagkgttggaggcaytgtttkt

SEQ ID NO: 120 - DNA, 60 bp, Artificial Sequence
  mutagenesis primer
  misc_feature (5)..(5): r is a or g
  misc_feature (11)..(11): y is c or t
  misc_feature (23)..(23): s is g or c
acgtragtcgytcctgtcccagstatccgaagcgccattggcgaccttaaagaagctggt

SEQ ID NO: 121 - DNA, 60 bp, Artificial Sequence
  mutagenesis primer
  misc_feature (5)..(5): r is a or g
  misc_feature (11)..(11): y is c ot t
  misc_feature (23)..(23): s is g or c
acgtragtcgytcctgtcccagstatccgaagcgcccggggcgaccttaaagaagctggt

SEQ ID NO: 122 - DNA, 60 bp, Artificial Sequence
  mutagenesis primer
  misc_feature (5)..(5): r is a or g
  misc_feature (11)..(11): y is c or t
  misc_feature (23)..(23): s is g or c
acgtragtcgytcctgtcccagstatccgaagcgccattggcgaccttaaatgggctggt

SEQ ID NO: 123 - DNA, 60 bp, Artificial Sequence
  mutagenesis primer
  misc_feature (5)..(5): r is a or g
  misc_feature (11)..(11): y is c or t
  misc_feature (23)..(23): s is g or c
acgtragtcgytcctgtcccagstatccgaagcgcccggggcgaccttaaatgggctggt

SEQ ID NO: 124 - DNA, 60 bp, Artificial Sequence
  mutagenesis primer
  misc_feature (8)..(8): w is a or t
  misc_feature (47)..(47): k is g or t
ggtagacwgaacgtagtaagggtgtgcagagccatttaattgtacakacatcacgaagcc

SEQ ID NO: 125 - DNA, 60 bp, Artificial Sequence
  mutagenesis primer
  misc_feature (8)..(8): w is a or t
  misc_feature (47)..(47): k is g or t
ggtagacwgaacgtagtaagggtgctgagagccatttaattgtacakacatcacgaagcc

SEQ ID NO: 126 - DNA, 60 bp, Artificial Sequence
  mutagenesis primer
  misc_feature (8)..(8): w is a or t
  misc_feature (47)..(47): k is g or t
ggtagacwgaacgtagtaagggtgtgcagagccccctaattgtacakacatcacgaagcc

SEQ ID NO: 127 - DNA, 60 bp, Artificial Sequence
  mutagenesis primer
  misc_feature (8)..(8): w is a or t
  misc_feature (47)..(47): k is g or t
ggtagacwgaacgtagtaagggtgctgagagccccctaattgtacakacatcacgaagcc

SEQ ID NO: 128 - DNA, 60 bp, Artificial Sequence
  mutagenesis primer
  misc_feature (8)..(8): w is a or t
  misc_feature (47)..(47): k is g or t
ggtagacwgaacgtagtaagggtgtgcagagccatttttttgtacakacatcacgaagcc

SEQ ID NO: 129 - DNA, 60 bp, Artificial Sequence
  mutagenesis primer
  misc_feature (8)..(8): w is a or t
  misc_feature (47)..(47): k is g or t
ggtagacwgaacgtagtaagggtgctgagagccatttttttgtacakacatcacgaagcc

SEQ ID NO: 130 - DNA, 60 bp, Artificial Sequence
  mutagenesis primer
  misc_feature (8)..(8): w is a or t
  misc_feature (47)..(47): k is g or t
ggtagacwgaacgtagtaagggtgtgcagagccccctttttgtacakacatcacgaagcc

SEQ ID NO: 131 - DNA, 60 bp, Artificial Sequence
  mutagenesis primer
  misc_feature (8)..(8): w is a or t
  misc_feature (47)..(47): k is g or t
ggtagacwgaacgtagtaagggtgctgagagccccctttttgtacakacatcacgaagcc

SEQ ID NO: 132 - DNA, 60 bp, Artificial Sequence
  mutagenesis primer
  misc_feature (29)..(29): k is g or t
  misc_feature (39)..(39): y is c or t
  misc_feature (42)..(42): y is c or t
  misc_feature (45)..(45): m is a or c
  misc_feature (50)..(50): w is a or t
  misc_feature (55)..(55): w is a or t
gagcggtaaaagggtctggccagaatctktcacggcgtygtygtmgattwcaatwttgct

SEQ ID NO: 133 - DNA, 60 bp, Artificial Sequence
  mutagenesis primer
  misc_feature (29)..(29): k is g or t
  misc_feature (39)..(39): y is c or t
  misc_feature (42)..(42): y is c or t
  misc_feature (45)..(45): m is a or c
  misc_feature (50)..(50): w is a or t
  misc_feature (55)..(55): w is a or t
gagcggtaaaagggtctggccttgatctktcacggcgtygtygtmgattwcaatwttgct

SEQ ID NO: 134 - DNA, 60 bp, Artificial Sequence
  mutagenesis primer
atcgaaggtaggcatatgggtattagtgttaaaaacagcgcgtccaacacggtggaagtc

SEQ ID NO: 135 - DNA, 60 bp, Artificial Sequence
  mutagenesis primer
gccatcaatcattggggtacggacggagacaccagcccgtttaaagtcggtccgggcgcc

SEQ ID NO: 136 - DNA, 60 bp, Artificial Sequence
  mutagenesis primer
agtgatacctgggacaggaacgaccttcgtggcttcgtgctttatgtacagttgggcggc

SEQ ID NO: 137 - DNA, 60 bp, Artificial Sequence
  mutagenesis primer
gcggcgcacccttactacgttctgtctagcagcaacattgttatctatgatgataaggtg

SEQ ID NO: 138 - DNA, 54 bp, Artificial Sequence
  mutagenesis primer
actgattcgggccagaccctgcttccgctctcgtaaggatccgaattcaagctt

SEQ ID NO: 139 - DNA, 60 bp, Artificial Sequence
  mutagenesis primer
gtctccgtccgtaccccaatgattgatggcgacttccaccgtgttggacgcgctgttttt

SEQ ID NO: 140 - DNA, 60 bp, Artificial Sequence
  mutagenesis primer
acgaaggtcgttcctgtcccaggtatcactggcgcccggaccgactttaaacgggctggt

SEQ ID NO: 141 - DNA, 60 bp, Artificial Sequence
  mutagenesis primer
gctagacagaacgtagtaagggtgcgccgcgccgcccaactgtacataaagcacgaagcc

SEQ ID NO: 142 - DNA, 60 bp, Artificial Sequence
  mutagenesis primer
gagcggaagcagggtctggcccgaatcagtcaccttatcatcatagataacaatgttgct

SEQ ID NO: 143 - DNA, 75 bp, Artificial Sequence
  mutagenesis primer
  misc_feature (20)..(20): s is g or c
  misc_feature (32)..(32): r is a or g
  misc_feature (34)..(34): k is g or t
  misc_feature (46)..(46): r is a or g
  misc_feature (55)..(55): k is g or t
ggtaggcatatggccattascgttaaaaacarckcttccaacacgrttgaagtckctatcaatcattggggtact

SEQ ID NO: 144 - DNA, 42 bp, Artificial Sequence
  mutagenesis primer
  misc_feature (4)..(4): r is a or g
  misc_feature (24)..(24): w is a or t
  misc_feature (26)..(26): s is g or c
aaartggccccgggcgctagcgawasctgggacaggaacgac

SEQ ID NO: 145 - DNA, 45 bp, Artificial Sequence
  mutagenesis primer
  misc_feature (16)..(16): m is a or c
  misc_feature (25)..(25): m is a or c
cttcgtggcttcgtgmtgtacgtgmagctggggggctcagcgact

SEQ ID NO: 146 - DNA, 75 bp, Artificial Sequence
  mutagenesis primer
  misc_feature (21)..(21): m is a or c
  misc_feature (30)..(30): y is c or t
  misc_feature (42)..(42): m is a or c
  misc_feature (44)..(44): y is c or t
  misc_feature (56)..(56): s is g or c
agtaccccaatgattgatagmgacttcaaycgtgttggaagmgytgtttttaacgstaatggccatatgcctacc

SEQ ID NO: 147 - DNA, 42 bp, Artificial Sequence
  mutagenesis primer
  misc_feature (17)..(17): s is g or c
  misc_feature (19)..(19): w is a or t
  misc_feature (39)..(39): y is c or t
gtcgttcctgtcccagstwtcgctagcgcccggggccayttt

SEQ ID NO: 148 - DNA, 45 bp, Artificial Sequence
  mutagenesis primer
  misc_feature (21)..(21): k is g or t
  misc_feature (30)..(30): k is g or t
agtcgctgagccccccagctkcacgtacakcacgaagccacgaag

SEQ ID NO: 149 - DNA, 75 bp, Artificial Sequence
  mutagenesis primer
  misc_feature (20)..(20): s is g or c
  misc_feature (32)..(32): r is a or g
  misc_feature (34)..(34): k is g or t
  misc_feature (46)..(46): r is a or g
  misc_feature (55)..(55): k is g or t
ggtaggcatatggcaattastgttacaaacartkcgtccaaccccrttgaagtckcgatcaatcattggggtacg

SEQ ID NO: 150 - DNA, 39 bp, Artificial Sequence
  mutagenesis primer
  misc_feature (21)..(21): w is a or t
  misc_feature (23)..(23): s is g or c
gtcgcaaacggcaagcaggawasttgggacaggtccgac

SEQ ID NO: 151 - DNA, 45 bp, Artificial Sequence
  mutagenesis primer
  misc_feature (16)..(16): w is a or t
  misc_feature (25)..(25): m is a or c
ctgcgtggcttcgtgwtgtccgtgmagaagaatggcgcgcaacac

SEQ ID NO: 152 - DNA, 57 bp, Artificial Sequence
  mutagenesis primer
  misc_feature (22)..(22): m is a or c
  misc_feature (35)..(35): r is a or g
gtgacggattccggccagttamttttgccgttaarttaaggatccgaattcaagctt

SEQ ID NO: 153 - DNA, 57 bp, Artificial Sequence
  mutagenesis primer
  misc_feature (22)..(22): m is a or c
  misc_feature (35)..(35): r is a or g
gtgacggattccggccagttamttttgccggctarttaaggatccgaattcaagctt

SEQ ID NO: 154 - DNA, 57 bp, Artificial Sequence
  mutagenesis primer
  misc_feature (22)..(22): m is a or c
  misc_feature (35)..(35): r is a or g
gtgacggattccggccagttamttgaaccgttaarttaaggatccgaattcaagctt

SEQ ID NO: 155 - DNA, 57 bp, Artificial Sequence
  mutagenesis primer
  misc_feature (22)..(22): m is a or c
  misc_feature (35)..(35): r is a or g
gtgacggattccggccagttamttgaaccggctarttaaggatccgaattcaagctt

SEQ ID NO: 156 - DNA, 57 bp, Artificial Sequence
  mutagenesis primer
  misc_feature (22)..(22): m is a or c
  misc_feature (35)..(35): r is a or g
gtgacggattccggccagacgmttttgccgttaarttaaggatccgaattcaagctt

SEQ ID NO: 157 - DNA, 57 bp, Artificial Sequence
  mutagenesis primer
  misc_feature (22)..(22): m is a or c
  misc_feature (35)..(35): r is a or g
gtgacggattccggccagacgmttttgccggctarttaaggatccgaattcaagctt

SEQ ID NO: 158 - DNA, 57 bp, Artificial Sequence
  mutagenesis primer
  misc_feature (22)..(22): m is a or c
  misc_feature (35)..(35): r is a or g
gtgacggattccggccagacgmttgaaccgttaarttaaggatccgaattcaagctt

SEQ ID NO: 159 - DNA, 57 bp, Artificial Sequence
  mutagenesis primer
  misc_feature (22)..(22): m is a or c
  misc_feature (35)..(35): r is a or g
gtgacggattccggccagacgmttgaaccggctarttaaggatccgaattcaagctt

SEQ ID NO: 160 - DNA, 75 bp, Artificial Sequence
  mutagenesis primer
  misc_feature (21)..(21): m is a or c
  misc_feature (30)..(30): y is c or t
  misc_feature (42)..(42): m is a or c
  misc_feature (44)..(44): y is c or t
  misc_feature (56)..(56): s is g or c
cgtaccccaatgattgatcgmgacttcaayggggttggacgmaytgtttgtaacastaattgccatatgcctacc

SEQ ID NO: 161 - DNA, 39 bp, Artificial Sequence
  mutagenesis primer
  misc_feature (17)..(17): s is g or c
  misc_feature (19)..(19): w is a or t
gtcggacctgtcccaastwtcctgcttgccgtttgcgac

SEQ ID NO: 162 - DNA, 45 bp, Artificial Sequence
  mutagenesis primer
  misc_feature (21)..(21): k is g or t
  misc_feature (390)..(30): w is a or t
gtgttgcgcgccattcttctkcacggacawcacgaagccacgcag

SEQ ID NO: 163 - DNA, 57 bp, Artificial Sequence
  mutagenesis primer
  misc_feature (23)..(23): y is c or t
  misc_feature (36)..(36): k is g or t
aagcttgaattcggatccttaayttaacggcaaaaktaactggccggaatccgtcac

SEQ ID NO: 164 - DNA, 57 bp, Artificial Sequence
  mutagenesis primer
  misc_feature (23)..(23): y is c or t
  misc_feature (36)..(36): k is g or t
aagcttgaattcggatccttaaytagccggcaaaaktaactggccggaatccgtcac

SEQ ID NO: 165 - DNA, 57 bp, Artificial Sequence
  mutagenesis primer
  misc_feature (23)..(23): y is c or t
  misc_feature (36)..(36): k is g or t
aagcttgaattcggatccttaayttaacggttcaaktaactggccggaatccgtcac

SEQ ID NO: 166 - DNA, 57 bp, Artificial Sequence
  mutagenesis primer
  misc_feature (23)..(23): y is c or t
  misc_feature (36)..(36): k is g or t
aagcttgaattcggatccttaaytagccggttcaaktaactggccggaatccgtcac

SEQ ID NO: 167 - DNA, 57 bp, Artificial Sequence
  mutagenesis primer
  misc_feature (23)..(23): y is c or t
  misc_feature (36)..(36): k is g or t
aagcttgaattcggatccttaayttaacggcaaaakcgtctggccggaatccgtcac

SEQ ID NO: 168 - DNA, 57 bp, Artificial Sequence
  mutagenesis primer
  misc_feature (23)..(23): y is c or t
  misc_feature (36)..(36): k is g or t
aagcttgaattcggatccttaaytagccggcaaaakcgtctggccggaatccgtcac

SEQ ID NO: 169 - DNA, 57 bp, Artificial Sequence
  mutagenesis primer
  misc_feature (23)..(23): y is c or t
  misc_feature (36)..(36): k is g or t
aagcttgaattcggatccttaayttaacggttcaakcgtctggccggaatccgtcac

SEQ ID NO: 170 - DNA, 57 bp, Artificial Sequence
  mutagenesis primer
  misc_feature (23)..(23): y is c or t
  misc_feature (36)..(36): k is g or t
aagcttgaattcggatccttaaytagccggttcaakcgtctggccggaatccgtcac

SEQ ID NO: 171 - DNA, 69 bp, Artificial Sequence
  mutagenesis primer
  misc_feature (24)..(24): s is g or c
  misc_feature (35)..(35): y is c or t
accgttacaaacaattcgtccaasaaaatcgaagyggccatcaataaatggggtagcgacggagacacc

SEQ ID NO: 172 - DNA, 69 bp, Artificial Sequence
  mutagenesis primer
  misc_feature (24)..(24): s is g or c
  misc_feature (35)..(35): y is c or t
accgttacaaacaattcgtccaasaaaatcgaagyggccatcaatcactggggtagcgacggagacacc

SEQ ID NO: 173 - DNA, 69 bp, Artificial Sequence
  mutagenesis primer
  misc_feature (24)..(24): s is g or c
  misc_feature (35)..(35): y is c or t
accgttacaaacaattcgtccaasccgatcgaagyggccatcaataaatggggtagcgacggagacacc

SEQ ID NO: 174 - DNA, 69 bp, Artificial Sequence
  mutagenesis primer
  misc_feature (24)..(24): s is g or c
  misc_feature (35)..(35): y is c or t
accgttacaaacaattcgtccaasccgatcgaagyggccatcaatcactggggtagcgacggagacacc

SEQ ID NO: 175 - DNA, 78 bp, Artificial Sequence
  mutagenesis primer
  misc_feature (31)..(31): r is a or g
  misc_feature (34)..(34): r is a or g
  misc_feature (38)..(38): r is a or g
  misc_feature (41)..(41): r is a or g
  misc_feature (55)..(55): w is a or t
tggggtagcgacggagacaccagcttctttrgcrttgrtarcggcaagcaggaawcctgggacaggtccgacagccgt

SEQ ID NO: 176 - DNA, 57 bp, Artificial Sequence
  mutagenesis primer
ggcttcgtgctttccctgaagaagaatggcgcgcaacacccttactacgttcaggcc

SEQ ID NO: 177 - DNA, 57 bp, Artificial Sequence
  mutagenesis primer
ggcttcgtgctttccctgaagaagaatggcgcgcaagcaccttactacgttcaggcc

SEQ ID NO: 178 - DNA, 57 bp, Artificial Sequence
  mutagenesis primer
ggcttcgtgctttccctgaagcgcaatggcgcgcaacacccttactacgttcaggcc

SEQ ID NO: 179 - DNA, 57 bp, Artificial Sequence
  mutagenesis primer
ggcttcgtgctttccctgaagcgcaatggcgcgcaagcaccttactacgttcaggcc

SEQ ID NO: 180 - DNA, 63 bp, Artificial Sequence
  mutagenesis primer
  misc_feature (19)..(19): w is a or t
  misc_feature (34)..(34): r is a or g
  misc_feature (38)..(38): m is a or c
  misc_feature (46)..(46): r is a or g
ccttactacgttcaggccwccagcaaaattgaarttgamaacaacrccgtgaaagatcagggc

SEQ ID NO: 181 - DNA, 55 bp, Artificial Sequence
  mutagenesis primer
  misc_feature (31)..(31): s is g or c
  misc_feature (34)..(34): k is g or t
gtgaaagatcagggcgaattgatcgagccgstgkcttaaggatccgaattcaagc

SEQ ID NO: 182 - DNA, 55 bp, Artificial Sequence
  mutagenesis primer
  misc_feature (31)..(31): s is g or c
  misc_feature (34)..(34): k is g or t
gtgaaagatcagggcgaattgatccacccgstgkcttaaggatccgaattcaagc

SEQ ID NO: 183 - DNA, 55 bp, Artificial Sequence
  mutagenesis primer
  misc_feature (31)..(31): s is g or c
  misc_feature (34)..(34): k is g or t
gtgaaagatcagggccgtttgatcgagccgstgkcttaaggatccgaattcaagc

SEQ ID NO: 184 - DNA, 55 bp, Artificial Sequence
  mutagenesis primer
  misc_feature (31)..(31): s is g or c
  misc_feature (34)..(34): k is g or t
gtgaaagatcagggccgtttgatccacccgstgkcttaaggatccgaattcaagc

SEQ ID NO: 185 - DNA, 69 bp, Artificial Sequence
  mutagenesis primer
accgttacaaacaattcgtccaagaagatcgaagctgccatcaataaatggggtagcgacggagacacc

SEQ ID NO: 186 - DNA, 78 bp, Artificial Sequence
  mutagenesis primer
tggggtagcgacggagacaccagcttctttggcattgacagcggcaagcaggaatcttgggacaggtccgacagccgt

SEQ ID NO: 187 - DNA, 57 bp, Artificial Sequence
  mutagenesis primer
ggcttcgtgctttccctgaagcgtaatggcgcgcaagctccttactacgttcaggcc

SEQ ID NO: 188 - DNA, 63 bp, Artificial Sequence
  mutagenesis primer
ccttactacgttcaggccactagcaaaattgaaattgaaaacaacacggtgaaagatcagggc

SEQ ID NO: 189 - DNA, 55 bp, Artificial Sequence
  mutagenesis primer
gtgaaagatcagggcgaattgatccacccggtcgcataaggatccgaattcaagc

SEQ ID NO: 190 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
atatgggtattaccgttacannkaattcgtccaaccccatcga

SEQ ID NO: 191 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
tcgatggggttggacgaattmnntgtaacggtaatacccatat

SEQ ID NO: 192 - DNA, 43 bp, Artificial Sequence
  mutagenesis primer
  misc_feature (22)..(22): n is g, a, c or t
  misc_feature (23)..(23): n is g, a, c or t
  misc_feature (24)..(24): k is g or t
atgggtattaccgttacaaacnnktcgtccaaccccatcgaag

SEQ ID NO: 193 - DNA, 43 bp, Artificial Sequence
  mutagenesis primer
  misc_feature (20)..(20): m is a or c
  misc_feature (21)..(21): n is g, a, c or t
  misc_feature (22)..(22): n is g, a, c or t
cttcgatggggttggacgamnngtttgtaacggtaatacccat

SEQ ID NO: 194 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
ttaccgttacaaacaattcgnnkaaccccatcgaagtcgccat

SEQ ID NO: 195 - DNA, 43 bp, Artificial Sequence
  mutagenesis primer
  misc_feature (21)..(21): m is a or c
  misc_feature (22)..(22): n is g, a, c or t
  misc_feature (22)..(23): n is g, a, c or t
atggcgacttcgatggggttmnncgaattgtttgtaacggtaa

SEQ ID NO: 196 - DNA, 48 bp, Artificial Sequence
  mutagenesis primer
  misc_feature (28)..(28): n is g, a, c or t
  misc_feature (29)..(29): n is g, a, c or t
  misc_feature (30)..(30): k is g or t
ggtattaccgttacaaacaattcgtccnnkcccatcgaagtcgccatc

SEQ ID NO: 197 - DNA, 48 bp, Artificial Sequence
  mutagenesis primer
  misc_feature (19)..(19): m is a or c
  misc_feature (20)..(20): n is g, a, c or t
  misc_feature (21)..(21): n is g, a, c or t
gatggcgacttcgatgggmnnggacgaattgtttgtaacggtaatacc

SEQ ID NO: 198 - DNA, 44 bp, Artificial Sequence
  mutagenesis primer
  misc_feature (23)..(23): n is g, a, c or t
  misc_feature (24)..(24): n is g, a, c or t
  misc_feature (25)..(25): k is g or t
cgttacaaacaattcgtccaacnnkatcgaagtcgccatcaatc

SEQ ID NO: 199 - DNA, 44 bp, Artificial Sequence
  mutagenesis primer
  misc_feature (20)..(20): m is a or c
  misc_feature (21)..(21): n is g, a, c or t
  misc_feature (22)..(22): n is g, a, c or t
gattgatggcgacttcgatmnngttggacgaattgtttgtaacg

SEQ ID NO: 200 - DNA, 46 bp, Artificial Sequence
  mutagenesis primer
  misc_feature (23)..(23): n is g, a, c or t
  misc_feature (24)..(24): n is g, a, c or t
  misc_feature (25)..(25): k is g or t
caattcgtccaaccccatcgaannkgccatcaatcattggggtagc

SEQ ID NO: 201 - DNA, 46 bp, Artificial Sequence
  mutagenesis primer
  misc_feature (22)..(22): m is a or c
  misc_feature (23)..(23): n is g, a, c or t
  misc_feature (24)..(24): n is g, a, c or t
gctaccccaatgattgatggcmnnttcgatggggttggacgaattg

SEQ ID NO: 202 - DNA, 45 bp, Artificial Sequence
  mutagenesis primer
  misc_feature (21)..(21): n is g, a, c or t
  misc_feature (22)..(22): n is g, a, c or t
  misc_feature (23)..(23): k is g or t
cgtccaaccccatcgaagtcnnkatcaatcattggggtagcgacg

SEQ ID NO: 203 - DNA, 45 bp, Artificial Sequence
  mutagenesis primer
  misc_feature (23)..(23): m is a or c
  misc_feature (24)..(24): n is g, a, c or t
  misc_feature (25)..(25): n is g, a, c or t
cgtcgctaccccaatgattgatmnngacttcgatggggttggacg

SEQ ID NO: 204 - DNA, 44 bp, Artificial Sequence
  mutagenesis primer
  misc_feature (21)..(21): n is g, a, c or t
  misc_feature (22)..(22): n is g, a, c or t
  misc_feature (23)..(23): k is g or t
ccatcgaagtcgccatcaatnnktggggtagcgacggagacacc

SEQ ID NO: 205 - DNA, 44 bp, Artificial Sequence
  mutagenesis primer
  misc_feature (22)..(22): m is a or c
  misc_feature (23)..(23): n is g, a, c or t
  misc_feature (24)..(24): n is g, a, c or t
ggtgtctccgtcgctaccccamnnattgatggcgacttcgatgg

SEQ ID NO: 206 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
tcgaagtcgccatcaatcatnnkggtagcgacggagacaccag

SEQ ID NO: 207 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
ctggtgtctccgtcgctaccmnnatgattgatggcgacttcga

SEQ ID NO: 208 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
ccatcaatcattggggtagcnnkggagacaccagcttcttttc

SEQ ID NO: 209 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
gaaaagaagctggtgtctccmnngctaccccaatgattgatgg

SEQ ID NO: 210 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
tcaatcattggggtagcgacnnkgacaccagcttcttttccgt

SEQ ID NO: 211 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
acggaaaagaagctggtgtcmnngtcgctaccccaatgattga

SEQ ID NO: 212 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
ggggtagcgacggagacaccnnkttcttttccgtcggtaacgg

SEQ ID NO: 213 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
ccgttaccgacggaaaagaamnnggtgtctccgtcgctacccc

SEQ ID NO: 214 - DNA, 44 bp, Artificial Sequence
  mutagenesis primer
  misc_feature (23)..(23): n is g, a, c or t
  misc_feature (24)..(24): n is g, a, c or t
  misc_feature (25)..(25): k is g or t
cgacggagacaccagcttctttnnkgtcggtaacggcaagcagg

SEQ ID NO: 215 - DNA, 44 bp, Artificial Sequence
  mutagenesis primer
  misc_feature (20)..(20): m is a or c
  misc_feature (21)..(21): n is g, a, c or t
  misc_feature (22)..(22): n is g, a, c or t
cctgcttgccgttaccgacmnnaaagaagctggtgtctccgtcg

SEQ ID NO: 216 - DNA, 45 bp, Artificial Sequence
  mutagenesis primer
  misc_feature (22)..(22): n is g, a, c or t
  misc_feature (23)..(23): n is g, a, c or t
  misc_feature (24)..(24): k is g or t
ggagacaccagcttcttttccnnkggtaacggcaagcaggaaacc

SEQ ID NO: 217 - DNA, 45 bp, Artificial Sequence
  mutagenesis primer
  misc_feature (22)..(22): m is a or c
  misc_feature (23)..(23): n is g, a, c or t
  misc_feature (24)..(24): n is g, a, c or t
ggtttcctgcttgccgttaccmnnggaaaagaagctggtgtctcc

SEQ ID NO: 218 - DNA, 48 bp, Artificial Sequence
  mutagenesis primer
  misc_feature (25)..(25): n is g, a, c or t
  misc_feature (26)..(26): n is g, a, c or t
  misc_feature (27)..(27): k is g or t
ggagacaccagcttcttttccgtcnnkaacggcaagcaggaaacctgg

SEQ ID NO: 219 - DNA, 48 bp, Artificial Sequence
  mutagenesis primer
  misc_feature (22)..(22): m is a or c
  misc_feature (23)..(23): n is g, a, c or t
  misc_feature (24)..(24): n is g, a, c or t
ccaggtttcctgcttgccgttmnngacggaaaagaagctggtgtctcc

SEQ ID NO: 220 - DNA, 42 bp, Artificial Sequence
  mutagenesis primer
  misc_feature (21)..(21): n is g, a, c or t
  misc_feature (22)..(22): n is g, a, c or t
  misc_feature (23)..(23): k is g or t
ccagcttcttttccgtcggtnnkggcaagcaggaaacctggg

SEQ ID NO: 221 - DNA, 42 bp, Artificial Sequence
  mutagenesis primer
  misc_feature (20)..(20): m is a or c
  misc_feature (21)..(21): n is g, a, c or t
  misc_feature (22)..(22): n is g, a, c or t
cccaggtttcctgcttgccmnnaccgacggaaaagaagctgg

SEQ ID NO: 222 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
gcttcttttccgtcggtaacnnkaagcaggaaacctgggacag

SEQ ID NO: 223 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
ctgtcccaggtttcctgcttmnngttaccgacggaaaagaagc

SEQ ID NO: 224 - DNA, 44 bp, Artificial Sequence
  mutagenesis primer
  misc_feature (21)..(21): n is g, a, c or t
  misc_feature (22)..(22): n is g, a, c or t
  misc_feature (23)..(23): k is g or t
gcttcgtgctttccctgaagnnkaatggcgcgcaacacccttac

SEQ ID NO: 225 - DNA, 44 bp, Artificial Sequence
  mutagenesis primer
  misc_feature (22)..(22): m is a or c
  misc_feature (23)..(23): n is g, a, c or t
  misc_feature (24)..(24): n is g, a, c or t
gtaagggtgttgcgcgccattmnncttcagggaaagcacgaagc

SEQ ID NO: 226 - DNA, 46 bp, Artificial Sequence
  mutagenesis primer
  misc_feature (23)..(23): n is g, a, c or t
  misc_feature (24)..(24): n is g, a, c or t
  misc_feature (25)..(25): k is g or t
gctttccctgaagaagaatggcnnkcaacacccttactacgttcag

SEQ ID NO: 227 - DNA, 46 bp, Artificial Sequence
  mutagenesis primer
  misc_feature (22)..(22): m is a or c
  misc_feature (23)..(23): n is g, a, c or t
  misc_feature (24)..(24): n is g, a, c or t
ctgaacgtagtaagggtgttgmnngccattcttcttcagggaaagc

SEQ ID NO: 228 - DNA, 44 bp, Artificial Sequence
  mutagenesis primer
  misc_feature (22)..(22): n is g, a, c or t
  misc_feature (23)..(23): n is g, a, c or t
  misc_feature (24)..(24): k is g ot t
ctgaagaagaatggcgcgcaannkccttactacgttcaggccag

SEQ ID NO: 229 - DNA, 44 bp, Artificial Sequence
  mutagenesis primer
  misc_feature (21)..(21): m is a or c
  misc_feature (22)..(22): n is g, a, c or t
  misc_feature (23)..(23): n is g, a, c or t
ctggcctgaacgtagtaaggmnnttgcgcgccattcttcttcag

SEQ ID NO: 230 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
agaatggcgcgcaacaccctnnktacgttcaggccagcagcaa

SEQ ID NO: 231 - DNA, 44 bp, Artificial Sequence
  mutagenesis primer
  misc_feature (21)..(21): m is a or c
  misc_feature (22)..(22): n is g, a, t or c
  misc_feature (23)..(23): n is g, a, t or c
  misc_feature (44)..(44): n is a, c, g, or t
ttgctgctggcctgaacgtamnnagggtgttgcgcgccattctn

SEQ ID NO: 232 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
atggcgcgcaacacccttacnnkgttcaggccagcagcaaaat

SEQ ID NO: 233 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
attttgctgctggcctgaacmnngtaagggtgttgcgcgccat

SEQ ID NO: 234 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
cacccttactacgttcaggccnnkagcaaaattgaagtcgacaac

SEQ ID NO: 235 - DNA, 45 bp, Artificial Sequence
  mutagenesis primer
  misc_feature (22)..(22): m is a or c
  misc_feature (23)..(23): n is g, a, t or c
  misc_feature (24)..(24): n is g, a, t or c
gttgtcgacttcaattttgctmnnggcctgaacgtagtaagggtg

SEQ ID NO: 236 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
cttactacgttcaggccagcnnkaaaattgaagtcgacaacaa

SEQ ID NO: 237 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
ttgttgtcgacttcaattttmnngctggcctgaacgtagtaag

SEQ ID NO: 238 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
acgttcaggccagcagcaaannkgaagtcgacaacaacgccgt

SEQ ID NO: 239 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
acggcgttgttgtcgacttcmnntttgctgctggcctgaacgt

SEQ ID NO: 240 - DNA, 41 bp, Artificial Sequence
  mutagenesis primer
  misc_feature (20)..(20): n is g, a, t or c
  misc_feature (21)..(21): n is g, a, t or c
  misc_feature (22)..(22): k is g or t
ggccagcagcaaaattgaannkgacaacaacgccgtgaaag

SEQ ID NO: 241 - DNA, 41 bp, Artificial Sequence
  mutagenesis primer
  misc_feature (20)..(20): m is a or c
  misc_feature (21)..(21): n is g, a, t or c
  misc_feature (22)..(22): n is g, a, t or c
ctttcacggcgttgttgtcmnnttcaattttgctgctggcc

SEQ ID NO: 242 - DNA, 44 bp, Artificial Sequence
  mutagenesis primer
  misc_feature (21)..(21): n is g, a, t or c
  misc_feature (22)..(22): n is g, a, t or c
  misc_feature (23)..(23): k is g or t
ccagcagcaaaattgaagtcnnkaacaacgccgtgaaagatcag

SEQ ID NO: 243 - DNA, 44 bp, Artificial Sequence
  mutagenesis primer
  misc_feature (22)..(22): m is a or c
  misc_feature (23)..(23): n is g, a, t or c
  misc_feature (24)..(24): n is g, a, t or c
ctgatctttcacggcgttgttmnngacttcaattttgctgctgg

SEQ ID NO: 244 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
gcaaaattgaagtcgacaacnnkgccgtgaaagatcagggccg

SEQ ID NO: 245 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
cggccctgatctttcacggcmnngttgtcgacttcaattttgc

SEQ ID NO: 246 - DNA, 47 bp, Artificial Sequence
  mutagenesis primer
  misc_feature (24)..(24): n is g, a, t or c
  misc_feature (25)..(25): n is g, a, t or c
  misc_feature (26)..(26): k is g or t
gcaaaattgaagtcgacaacaacnnkgtgaaagatcagggccggttg

SEQ ID NO: 247 - DNA, 47 bp, Artificial Sequence
  mutagenesis primer
  misc_feature (22)..(22): m is a or c
  misc_feature (23)..(23): n is g, a, t or c
  misc_feature (24)..(24): n is g, a, t or c
caaccggccctgatctttcacmnngttgttgtcgacttcaattttgc

SEQ ID NO: 248 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
ttgaagtcgacaacaacgccnnkaaagatcagggccggttgat

SEQ ID NO: 249 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
atcaaccggccctgatctttmnnggcgttgttgtcgacttcaa

SEQ ID NO: 250 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
tcgacaacaacgccgtgaaannkcagggccggttgatcgagcc

SEQ ID NO: 251 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
ggctcgatcaaccggccctgmnntttcacggcgttgttgtcga

SEQ ID NO: 252 - DNA, 42 bp, Artificial Sequence
  mutagenesis primer
  misc_feature (22)..(22): n is g, a, t or c
  misc_feature (23)..(23): n is g, a, t or c
  misc_feature (24)..(24): k is g or t
gacaacaacgccgtgaaagatnnkggccggttgatcgagccg

SEQ ID NO: 253 - DNA, 42 bp, Artificial Sequence
  mutagenesis primer
  misc_feature (19)..(19): m is a or c
  misc_feature (20)..(20): n is g, a, t or c
  misc_feature (21)..(21): n is g, a, t or c
cggctcgatcaaccggccmnnatctttcacggcgttgttgtc

SEQ ID NO: 254 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
acaacgccgtgaaagatcagnnkcggttgatcgagccgctctc

SEQ ID NO: 255 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
gagagcggctcgatcaaccgmnnctgatctttcacggcgttgt

SEQ ID NO: 256 - DNA, 49 bp, Artificial Sequence
  mutagenesis primer
  misc_feature (23)..(23): n is g, a, t or c
  misc_feature (24)..(24): n is g, a, t or c
  misc_feature (25)..(25): k is g or t
caacgccgtgaaagatcagggcnnkttgatcgagccgctctcgtaaggr

SEQ ID NO: 257 - DNA, 48 bp, Artificial Sequence
  mutagenesis primer
  misc_feature (24)..(24): m is a or c
  misc_feature (25)..(25): n is g, a, t or c
  misc_feature (26)..(26): n is g, a, t or c
ccttacgagagcggctcgatcaamnngccctgatctttcacggcgttg

SEQ ID NO: 258 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
ccgtgaaagatcagggccggnnkatcgagccgctctcgtaagg

SEQ ID NO: 259 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
ccttacgagagcggctcgatmnnccggccctgatctttcacgg

SEQ ID NO: 260 - DNA, 44 bp, Artificial Sequence
  mutagenesis primer
  misc_feature (23)..(23): n is g, a, t or c
  misc_feature (24)..(24): n is g, a, t or c
  misc_feature (25)..(25): k is g or t
gaaagatcagggccggttgatcnnkccgctctcgtaaggatccg

SEQ ID NO: 261 - DNA, 44 bp, Artificial Sequence
  mutagenesis primer
  misc_feature (20)..(20): m is a or c
  misc_feature (21)..(21): n is g, a, t or c
  misc_feature (22)..(22): n is g, a, t or c
cggatccttacgagagcggmnngatcaaccggccctgatctttc

SEQ ID NO: 262 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
atcagggccggttgatcgagnnkctctcgtaaggatccgaatt

SEQ ID NO: 263 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
aattcggatccttacgagagmnnctcgatcaaccggccctgat

SEQ ID NO: 264 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
cagggccggttgatcgagccgnnktcgtaaggatccgaattcaag

SEQ ID NO: 265 - DNA, 45 bp, Artificial Sequence
  mutagenesis primer
  misc_feature (22)..(22): m is a or c
  misc_feature (23)..(23): n is g, a, t or c
  misc_feature (24)..(24): n is g, a, t or c
cttgaattcggatccttacgamnncggctcgatcaaccggccctg

SEQ ID NO: 266 - DNA, 42 bp, Artificial Sequence
  mutagenesis primer
  misc_feature (21)..(21): n is g, a, t or c
  misc_feature (22)..(22): n is g, a, t or c
  misc_feature (23)..(23): k is g or t
gccggttgatcgagccgctcnnktaaggatccgaattcaagc

SEQ ID NO: 267 - DNA, 42 bp, Artificial Sequence
  mutagenesis primer
  misc_feature (20)..(20): m is a or c
  misc_feature (21)..(21): n is g, a, t or c
  misc_feature (22)..(22): n is g, a, t or c
gcttgaattcggatccttamnngagcggctcgatcaaccggc

SEQ ID NO: 268 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
tccgtcggtaacggcaagcagnnkacctgggacaggtccgacagc

SEQ ID NO: 269 - DNA, 42 bp, Artificial Sequence
  mutagenesis primer
  misc_feature (20)..(20): n is g, a, t or c
  misc_feature (21)..(21): n is g, a, t or c
  misc_feature (22)..(22): k is g or t
cggtaacggcaagcaggaannktgggacaggtccgacagccg

SEQ ID NO: 270 - DNA, 42 bp, Artificial Sequence
  mutagenesis primer
  misc_feature (21)..(21): m is a or c
  misc_feature (22)..(22): n is g, a, t or c
  misc_feature (23)..(23): n is g, a, t or c
cggctgtcggacctgtcccamnnttcctgcttgccgttaccg

SEQ ID NO: 271 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
ggtaacggcaagcaggaaaccnnkgacaggtccgacagccgtggc

SEQ ID NO: 272 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
aacggcaagcaggaaacctggnnkaggtccgacagccgtggcttc

SEQ ID NO: 273 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
ggcaagcaggaaacctgggacnnktccgacagccgtggcttcgtg

SEQ ID NO: 274 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
aagcaggaaacctgggacaggnnkgacagccgtggcttcgtgctt

SEQ ID NO: 275 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
caggaaacctgggacaggtccnnkagccgtggcttcgtgctttcc

SEQ ID NO: 276 - DNA, 42 bp, Artificial Sequence
  mutagenesis primer
  misc_feature (22)..(22): n is g, a, t or c
  misc_feature (23)..(23): n is g, a, t or c
  misc_feature (24)..(24): k is g or t
gaaacctgggacaggtccgacnnkcgtggcttcgtgctttcc

SEQ ID NO: 277 - DNA, 42 bp, Artificial Sequence
  mutagenesis primer
  misc_feature (19)..(19): m is a or c
  misc_feature (20)..(20): n is g, a, t or c
  misc_feature (21)..(21): n is g, a, t or c
ggaaagcacgaagccacgmnngtcggacctgtcccaggtttc

SEQ ID NO: 278 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
acctgggacaggtccgacagcnnkggcttcgtgctttccctgaag

SEQ ID NO: 279 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
tgggacaggtccgacagccgtnnkttcgtgctttccctgaagaag

SEQ ID NO: 280 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
gacaggtccgacagccgtggcnnkgtgctttccctgaagaagaat

SEQ ID NO: 281 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
aggtccgacagccgtggcttcnnkctttccctgaagaagaatggc

SEQ ID NO: 282 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
tccgacagccgtggcttcgtgnnktccctgaagaagaatggcgcg

SEQ ID NO: 283 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
gacagccgtggcttcgtgcttnnkctgaagaagaatggcgcgcaa

SEQ ID NO: 284 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
agccgtggcttcgtgctttccnnkaagaagaatggcgcgcaacac

SEQ ID NO: 285 - DNA, 16 bp, Artificial Sequence
  16S primer
taccttgttacgactt

SEQ ID NO: 286 - DNA, 20 bp, Artificial Sequence
  16S primer
agagtttgatcmtggctcag

SEQ ID NO: 287 - DNA, 261 bp, Artificial Sequence
  coding sequence for PIP-72 polypeptide
atggcgatttctgttaaaaacaatgcgtccaaccccgtcgaagtcgccatcaatcattggggtacagacggagacaccaaaccgttttccgtcgcgccgggcgcctccgatagctgggacaggaacgaccttcgtggcttcgtgatgtatgttcaactgggcggctccgcacacccttactacgttctgagcaccagcaacattgtgatctatgacgataaagtgaccgattcgggccaaactcttctgccgctctcgtaa

SEQ ID NO: 288 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatacttgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 289 - DNA, 261 bp, Artificial Sequence
  coding sequence for PIP-72 polypeptide
atggccattactgttaaaaacagcgcgtccaacactattgaagtctcgatcaatcattggggtactgacggagacaccaagccgtttaaagtggctccaggcgccagtgaaacttgggacaggaacgacttacgtggcttcgtgttgtacgtgcagctgggtggctcggctaccccttactacgttttgtcaagtagcaacattgtcatttacgatgataaagtgaccgatagtggccagacgattttgccgctctcgtaa

SEQ ID NO: 290 - DNA, 261 bp, Artificial Sequence
  coding sequence for PIP-72 polypeptide
atggccattactgttaaaaacagcgcgtccaacactattgaagtctcgatcaatcattggggtagtgacggagacaccaagccgtttaaagtggctccaggcgccagtgaaacttgggacaggaacgacttacgtggcttcgtgttgtacctgcagctgggtggctcggctaccccttactacgttttgtcaactagcaacattgtcatttacgatgataaagtgaccgatagtggccagacgattttgccgctctcgtaa

SEQ ID NO: 291 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 292 - DNA, 261 bp, Artificial Sequence
  coding sequence for PIP-72 polypeptide
atggccattagcgttaaaaacagcgcttccaacacggttgaagtcgctatcaatcattggggtactgacggagacaccaagccgtttaaagtggctccaggcgccagtgaaacttgggacaggaacgacttacgtggcttcgtgttgtacgtgcagctgggtggctcggctaccccttactacgttttgtcaagtagcaacattgtcatttacgatgataaagtgaccgatagtggccagacgattttgccgctctcgtaa

SEQ ID NO: 293 - DNA, 261 bp, Artificial Sequence
  coding sequence for PIP-72 polypeptide
atggccattactgttaaaaacagcgcttccaacacggttgaagtcgctatcaatcattggggtactgacggagacaccaagccgtttaaagtggctccaggcgccagtgaaacttgggacaggaacgacttacgtggcttcgtgctgtacgtgcagctggggggctcggctaccccttactacgttttgtcaagtagcaacattgtcatttacgatgataaagtgaccgatagtggccagacgattttgccgctctcgtaa

SEQ ID NO: 294 - DNA, 261 bp, Artificial Sequence
  coding sequence for PIP-72 polypeptide
atggccattactgttaaaaacagcgcgtccaacactattgaagtcgctatcaatcattggggtactgacggagacaccaagccgtttaaagtggctccaggcgccagtgaaacttgggacaggaacgacttacgtggcttcgtgatgtacgtgaagctggggggctcggctaccccttactacgttttgtcaagtagcaacattgtcatttacgatgataaagtgaccgatagtggccagacgattttgccgctctcgtaa

SEQ ID NO: 295 - DNA, 261 bp, Artificial Sequence
  coding sequence for PIP-72 polypeptide
atggccattactgttaaaaacagcgcgtccaacactattgaagtctcgatcaatcattggggtactgacggagacaccaagccgtttaaagtggccccgggcgctagcgaaacctgggacaggaacgacttacgtggcttcgtgatgtacgtgcagctggggggctcggctaccccttactacgttttgtcaagtagcaacattgtcatttacgatgataaagtgaccgatagtggccagacgattttgccgctctcgtaa

SEQ ID NO: 296 - DNA, 261 bp, Artificial Sequence
  coding sequence for PIP-72 polypeptide
atggccattactgttaaaaacagcgcgtccaacactattgaagtctcgatcaatcattggggtactgacggagacaccaagccgtttaaagtggccccgggcgctagcgatagctgggacaggaacgacttacgtggcttcgtgttgtacgtgcagctgggtggctcggctaccccttactacgttttgtcaagtagcaacattgtcatttacgatgataaagtgaccgatagtggccagacgattttgccgctctcgtaa

SEQ ID NO: 297 - DNA, 261 bp, Artificial Sequence
  coding sequence for PIP-72 polypeptide
atggccattagcgttaaaaacagctcttccaacacgattgaagtcgctatcaatcattggggtactgacggagacaccaagccgtttaaagtggctccaggcgccagtgaaacttgggacaggaacgacttacgtggcttcgtgttgtacgtgcagctgggtggctcggctaccccttactacgttttgtcaagtagcaacattgtcatttacgatgataaagtgaccgatagtggccagacgattttgccgctctcgtaa

SEQ ID NO: 298 - DNA, 261 bp, Artificial Sequence
  coding sequence for PIP-72 polypeptide
atggccattaccgttaaaaacaactcttccaacacgattgaagtctctatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 299 - DNA, 261 bp, Artificial Sequence
  coding sequence for PIP-72 polypeptide
atggccattaccgttaaaaacaacgcttccaacacgattgaagtcgctatcaatcattggggtactgacggagacaccaaaccgtttaaaatggccccgggcgctagcgaaagctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 300 - DNA, 261 bp, Artificial Sequence
  coding sequence for PIP-72 polypeptide
atggccattagcgttaaaaacaacgcttccaacacggtcgaagtctctatcaatcattggggtactgacggagacaccaaaccgtttaaaatggccccgggcgctagcgatacttgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 301 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 302 - DNA, 261 bp, Artificial Sequence
  coding sequence for PIP-72 polypeptide
atggccattagcgttaaaaacagctcttccaacacgattgaagtctctatcaatcattggggtactgacggagacaccaaaccgtttaaaatggccccgggcgctagcgatacctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 303 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatacttgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 304 - DNA, 261 bp, Artificial Sequence
  coding sequence for PIP-72 polypeptide
atggccattaccgttaaaaacagctcttccaacacgattgaagtcgctatcaatcattggggtactgacggagacaccaaaccgtttaaaatggccccgggcgctagcgaaacctgggacaggaacgaccttcgtggcttcgtgatgtacgtgcagctggggggctcagcgactccttactacgttcttagcactagcaatattgtcatttacgatgataaagtgacagatagcggccagacactgctgccgctctcgtaa

SEQ ID NO: 305 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 306 - DNA, 261 bp, Artificial Sequence
  coding sequence for PIP-72 polypeptide
atggccattagcgttaaaaacagctcttccaacacgattgaagtctctatcaatcattggggtactgacggagacaccaaaccgtttaaaatggccccgggcgctagcgaaacctgggacaggaacgaccttcgtggcttcgtgatgtacgtgcagctggggggctcagcgactccttactacgttcttagcactagcaatattgtcatttacgatgataaagtgacagatagcggccagacactgctgccgctctcgtaa

SEQ ID NO: 307 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgaaacctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 308 - DNA, 261 bp, Artificial Sequence
  coding sequence for PIP-72 polypeptide
atggccattaccgttaaaaacagcgcttccaacacggttgaagtctctatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 309 - DNA, 261 bp, Artificial Sequence
  coding sequence for PIP-72 polypeptide
atggccattagcgttaaaaacagcgcatccaacacgattgaagtctctatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 310 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgaaacctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 311 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatagctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 312 - DNA, 261 bp, Artificial Sequence
  coding sequence for PIP-72 polypeptide
atggccattaccgttaaaaacaacgcttccaacacggttgaagtcgctatcaatcattggggtactgacggagacaccaaaccgtttaaaatggccccgggcgctagcgaaacctgggacaggaacgaccttcgtggcttcgtgatgtacgtgcagctggggggctcagcgactccttactacgttcttagcactagcaatattgtcatttacgatgataaagtgacagatagcggccagacactgctgccgctctcgtaa

SEQ ID NO: 313 - DNA, 261 bp, Artificial Sequence
  coding sequence for PIP-72 polypeptide
atggccattagcgttaaaaacaactcttccaacacgattgaagtctctatcaatcattggggtactgacggagacaccaaaccgtttaaaatggccccgggcgctagcgatagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 314 - DNA, 261 bp, Artificial Sequence
  coding sequence for PIP-72 polypeptide
atggccattagcgttaaaaacagcgcttccaacacgattgaagtctctatcaatcattggggtactgacggagacaccaaaccgtttaaaatggccccgggcgctagcgatagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 315 - DNA, 261 bp, Artificial Sequence
  coding sequence for PIP-72 polypeptide
atggccattagcgttaaaaacagctcttccaacacggttgaagtcgctatcaatcattggggtactgacggagacaccaaaccgtttaaaatggccccgggcgctagcgatagctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 316 - DNA, 261 bp, Artificial Sequence
  coding sequence for PIP-72 polypeptide
atggccattaccgttaaaaacagcgcttccaacacgattgaagtcgctatcaatcattggggtactgacggagacaccaaaccgtttaaaatggccccgggcgctagcgatacctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 317 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatacctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 318 - DNA, 261 bp, Artificial Sequence
  coding sequence for PIP-72 polypeptide
atggccattagtgttaaaaacaactcttccaacacggttgaagtcgctatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 319 - DNA, 261 bp, Artificial Sequence
  coding sequence for PIP-72 polypeptide
atggccattagcgttaaaaacagctcttccaacacggttgaagtcgctatcaatcattggggtactgacggagacaccaaaccgtttaaaatggccccgggcgctagcgaaagctgggacaggaacgaccttcgtggcttcgtgatgtacgtgcagctggggggctcagcgactccttactacgttcttagcactagcaatattgtcatttacgatgataaagtgacagatagcggccagacactgctgccgctctcgtaa

SEQ ID NO: 320 - DNA, 261 bp, Artificial Sequence
  coding sequence for PIP-72 polypeptide
atggccattaccgttaaaaacagcgcttccaacacggttgaagtcgctatcaatcattggggtactgacggagacaccaaaccgtttaaaatggccccgggcgctagcgatacctgggacaggaacgaccttcgtggcttcgtgatgtacgtgaagctggggggctcagcgactccttactacgttcttagcactagcaatattgtcatttacgatgataaagtgacagatagcggccagacactgctgccgctctcgtaa

SEQ ID NO: 321 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatacttgggacaggaacgaccttcgtggcttcgtgctgtacgtgaagctggggggctcagcgactccttactacgttcttagcactagcaatattgtcatttacgatgataaagtgacagatagcggccagacactgctgccgctctcgtaa

SEQ ID NO: 322 - DNA, 261 bp, Artificial Sequence
  coding sequence for PIP-72 polypeptide
atggccattagcgttaaaaacagctcttccaacacggttgaagtctctatcaatcattggggtactgacggagacaccaaaccgtttaaaatggccccgggcgctagcgatacctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 323 - DNA, 261 bp, Artificial Sequence
  coding sequence for PIP-72 polypeptide
atggcaattagtgttacaaacagtgcgtccaaccccgttgaagtcgcgatcaatcattggggtacggacggagacaccagcttcttttccgtcgcaaacggcaagcaggaaagttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 324 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagttaattttgccgttaagttaa

SEQ ID NO: 325 - DNA, 261 bp, Artificial Sequence
  coding sequence for PIP-72 polypeptide
atggcaatttcagttacaaacaatgcgtccaaccccattgaagtcgcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 326 - DNA, 261 bp, Artificial Sequence
  coding sequence for PIP-72 polypeptide
atggcaattagtgttacaaacaatgcgtccaaccccgttgaagtcgcgatcaatcattggggtacggacggagacaccagcttcttttccgtcgcaaacggcaagcaggactcttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 327 - DNA, 261 bp, Artificial Sequence
  coding sequence for PIP-72 polypeptide
atggcaattagtgttacaaacaatgcgtccaaccccattgaagtcgcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 328 - DNA, 261 bp, Artificial Sequence
  coding sequence for PIP-72 polypeptide
atggcaattagtgttacaaacagtgcgtccaaccccgttgaagtcgcgatcaatcattggggtacggacggagacaccagcttcttttccgtcgcaaacggcaagcaggatagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 329 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggaaacttgggacaggtccgacctgcgtggcttcgtgttgtccgtgcagaagaatggcgcgcaacacccttactacgttctttccaccagcaatattgtcatttatgatgacaaggtgacggattccggccagacattgctgccgctctcgtaa

SEQ ID NO: 330 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggaaagttgggacaggtccgacctgcgtggcttcgtgttgtccgtgcagaagaatggcgcgcaacacccttactacgttctttccaccagcaatattgtcatttatgatgacaaggtgacggattccggccagacattgctgccgctctcgtaa

SEQ ID NO: 331 - DNA, 261 bp, Artificial Sequence
  coding sequence for PIP-72 polypeptide
atggcaatttcagttacaaacaatgcgtccaaccccgttgaagtctcgatcaatcattggggtacggacggagacaccagcttcttttccgtcgcaaacggcaagcaggatagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtag

SEQ ID NO: 332 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacgcttgaaccgttaagttaa

SEQ ID NO: 333 - DNA, 261 bp, Artificial Sequence
  coding sequence for PIP-72 polypeptide
atggcaatttcagttacaaacaatgcgtccaaccccgtggaagtcgcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 334 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 335 - DNA, 261 bp, Artificial Sequence
  coding sequence for PIP-72 polypeptide
atggcaatttcagttacaaacaattcgtccaaccccattgaagtcgcgatcaatcattggggtacggacggagacaccagcttcttttccgtcgcaaacggcaagcaggactcttgggacaggtccgacctgcgtggcttcgtgttgtccgtgaagaagaatggcgcgcaacacccttactacgttctttccaccagcaatattgtcatttatgatgacaaggtgacggattccggccagacattgctgccgctctcgtaa

SEQ ID NO: 336 - DNA, 261 bp, Artificial Sequence
  coding sequence for PIP-72 polypeptide
atggcaattagtgttacaaacaattcgtccaaccccattgaagtcgcgatcaatcattggggtacggacggagacaccagcttcttttccgtcgcaaacggcaagcaggatacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 337 - DNA, 261 bp, Artificial Sequence
  coding sequence for PIP-72 polypeptide
atggcaatttcagttacaaacaatgcgtccaaccccattgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 338 - DNA, 261 bp, Artificial Sequence
  coding sequence for PIP-72 polypeptide
atggcaatttcagttacaaacagtgcgtccaaccccgttgaagtctcgatcaatcattggggtacggacggagacaccagcttcttttccgtcgcaaacggcaagcaggatacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 339 - DNA, 261 bp, Artificial Sequence
  coding sequence for PIP-72 polypeptide
atggcaatttcagttacaaacaatgcgtccaaccccgttgaagtctcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacgattttgccgttaagttaa

SEQ ID NO: 340 - DNA, 261 bp, Artificial Sequence; identical to SEQ ID NO: 334
  coding sequence for PIP-72 polypeptide

SEQ ID NO: 341 - DNA, 261 bp, Artificial Sequence
  coding sequence for PIP-72 polypeptide
atggcaattactgttacaaacaattcgtccaaccccgttgaagtcgcgatcaatcattggggtacggacggagacaccagcttcttttccgtcgcaaacggcaagcaggaaacttgggacaggtccgacctgcgtggcttcgtgttgtccgtgaagaagaatggcgcgcaacacccttactacgttctttccaccagcaatattgtcatttatgatgacaaggtgacggattccggccagacgcttttgccggctagttaa

SEQ ID NO: 342 - DNA, 261 bp, Artificial Sequence
  coding sequence for PIP-72 polypeptide
atggcaattagtgttacaaacaatgcgtccaaccccgttgaagtctcgatcaatcattggggtacggacggagacaccagcttcttttccgtcgcaaacggcaagcaggaaacttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 343 - DNA, 261 bp, Artificial Sequence
  coding sequence for PIP-72 polypeptide
atggcaatttcagttacaaacaatgcgtccaaccccattgaagtcgcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagttaattttgccggctagttaa

SEQ ID NO: 344 - DNA, 261 bp, Artificial Sequence
  coding sequence for PIP-72 polypeptide
atggcaattagtgttacaaacaatgcgtccaaccccgttgaagtctcgatcaatcattggggtacggacggagacaccagcttcttttccgtcgcaaacggcaagcaggatagttgggacaggtccgacctgcgtggcttcgtgatgtccgtgcagaagaatggcgcgcaacacccttactacgttctttccaccagcaatattgtcatttatgatgacaaggtgacggattccggccagttaattgaaccgttaagttaa

SEQ ID NO: 345 - DNA, 261 bp, Artificial Sequence
  coding sequence for PIP-72 polypeptide
atggcaattagtgttacaaacaattcgtccaaccccattgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 346 - DNA, 261 bp, Artificial Sequence
  coding sequence for PIP-72 polypeptide
atggcaattagtgttacaaacaatgcgtccaaccccattgaagtcgcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 347 - DNA, 261 bp, Artificial Sequence
  coding sequence for PIP-72 polypeptide
atggcaattagtgttacaaacagtgcgtccaaccccgttgaagtcgcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 348 - DNA, 261 bp, Artificial Sequence
  coding sequence for PIP-72 polypeptide
atggcaattagtgttacaaacaatgcgtccaaccccattgaagtctcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacgcttgaaccgttaagttaa

SEQ ID NO: 349 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggactcttgggacaggtccgacctgcgtggcttcgtgatgtccgtgaagaagaatggcgcgcaacacccttactacgttctttccaccagcaatattgtcatttatgatgacaaggtgacggattccggccagacgattttgccgttaagttaa

SEQ ID NO: 350 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggatacttgggacaggtccgacctgcgtggcttcgtgatgtccgtgcagaagaatggcgcgcaacacccttactacgttctttccaccagcaatattgtcatttatgatgacaaggtgacggattccggccagacatttgtaccggtttcttaa

SEQ ID NO: 351 - DNA, 261 bp, Artificial Sequence
  coding sequence for PIP-72 polypeptide
atggcaattactgttacaaacagtgcgtccaaccccgttgaagtcgcgatcaatcattggggtacggacggagacaccagcttcttttccgtcgcaaacggcaagcaggatagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 352 - DNA, 261 bp, Artificial Sequence
  coding sequence for PIP-72 polypeptide
atggcaatttcagttacaaacaatgcgtccaaccccgtggaagtcgcgatcaatcattggggtacggacggagacaccagcttcttttccgtcgcaaacggcaagcaggatacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 353 - DNA, 261 bp, Artificial Sequence
  coding sequence for PIP-72 polypeptide
atggcaattagtgttacaaacagttcgtccaaccccgttgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 354 - DNA, 261 bp, Artificial Sequence
  coding sequence for PIP-72 polypeptide
atggcaattagtgttacaaacaatgcgtccaaccccattgaagtcgcgatcaatcattggggtacggacggagacaccagcttcttttccgtcgcaaacggcaagcaggactcttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 355 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagttaattgaaccgttaagttaa

SEQ ID NO: 356 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggaaagttgggacaggtccgacctgcgtggcttcgtgttgtccgtgaagaagaatggcgcgcaacacccttactacgttctttccaccagcaatattgtcatttatgatgacaaggtgacggattccggccagttaattgaaccgttaagttaa

SEQ ID NO: 357 - DNA, 261 bp, Artificial Sequence
  coding sequence for PIP-72 polypeptide
atggcaattactgttacaaacaatgcgtccaaccccgttgaagtctcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagacgcttttgccgttaaattaa

SEQ ID NO: 358 - DNA, 261 bp, Artificial Sequence
  coding sequence for PIP-72 polypeptide
atggcaattactgttacaaacagtgcgtccaaccccgttgaagtcgcgatcaatcattggggtacggacggagacaccagcttcttttccgtcgcaaacggcaagcaggatagttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 359 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggaaacttgggacaggtccgacctgcgtggcttcgtgttgtccgtgaagaagaatggcgcgcaacacccttactacgttctttccaccagcaatattgtcatttatgatgacaaggtgacggattccggccagacattgctgccgctctcgtaa

SEQ ID NO: 360 - DNA, 261 bp, Artificial Sequence
  coding sequence for PIP-72 polypeptide
atggcaattagtgttacaaacaattcgtccaaccccattgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacgattgaaccgttaagttaa

SEQ ID NO: 361 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggatacttgggacaggtccgacctgcgtggcttcgtgatgtccgtgaagaagaatggcgcgcaacacccttactacgttctttccaccagcaatattgtcatttatgatgacaaggtgacggattccggccagttacttttgccgttaagttaa

SEQ ID NO: 362 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacgattttgccgttaaattaa

SEQ ID NO: 363 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggatagttgggacaggtccgacctgcgtggcttcgtgatgtccgtgaagaagaatggcgcgcaacacccttactacgttctttccaccagcaatattgtcatttatgatgacaaggtgacggattccggccagttacttgaaccgttaagttaa

SEQ ID NO: 364 - DNA, 261 bp, Artificial Sequence
  coding sequence for PIP-72 polypeptide
atggcaattagtgttacaaacaatgcgtccaaccccgttgaagtctcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagttacttgaaccgttaagttaa

SEQ ID NO: 365 - DNA, 261 bp, Artificial Sequence
  coding sequence for PIP-72 polypeptide
atggcaattagtgttacaaacagttcgtccaaccccgttgaagtctcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacgcttttgccggctagttaa

SEQ ID NO: 366 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggatagttgggacaggtccgacctgcgtggcttcgtgttgtccgtgcagaagaatggcgcgcaacacccttactacgttctttccaccagcaatattgtcatttatgatgacaaggtgacggattccggccagacattgctgccgctctcgtaa

SEQ ID NO: 367 - DNA, 261 bp, Artificial Sequence
  coding sequence for PIP-72 polypeptide
atgggtattaccgttacaaacaactcgtccggcccgatcgaagtcgccatcaatcattggggtagcgacggagacacccaattctttcctgtcggcagcggcaagcaggaatcttgggacaggtccgacgatcgtggcttcgtgctttccctgaagaataatggcgcgcaacacccttactacgttcaggccagcagcaaaattgaagtcgagaacaactacgtgaaagattctggcgagttgatcctgccgctctcgtaa

SEQ ID NO: 368 - DNA, 261 bp, Artificial Sequence
  coding sequence for PIP-72 polypeptide
atgggtattaccgttacaaacaactcgtccggcgacatcgaagtcgccatcaatcattggggtagcgacggagacacccaattctttaaggtcgccccaggcaagcaggaatcttgggacaggtccgacgctcgtggcttcgtgctttccctgaagaataatggcgcgcaacacccttactacgttcaggccagcagcaaaattgaagtcgagaacaacgcggtgaaagatcagggccagttgatcctgccgctctcgtaa

SEQ ID NO: 369 - DNA, 261 bp, Artificial Sequence
  coding sequence for PIP-72 polypeptide
atgggtattaccgttacaaacaactcgtccggcgacatcgaagtcgccatcaatcattggggtagcgacggagacacctccttctttaaggtcgccccaggcaagcaggaaacttgggacaggtccgacgatcgtggcttcgtgctttccctgaagaataatggcgcgcaacacccttactacgttcaggccagcagcaaaattgaagtcgagaacgactacgtgaaagatcagggccagttgatcctgccgctctcgtaa

SEQ ID NO: 370 - DNA, 261 bp, Artificial Sequence
  coding sequence for PIP-72 polypeptide
atgggtattaccgttacaaacaacttgtccaacgacatcgaagtcgccatcaatcattggggtagcgacggagacacccaattctttaaggtcggcccaggcaagcaggaatcttgggacaggtccgacgctcgtggcttcgtgctttccctgaagaagaatggcgcgcaacacccttactacgttcaggccagcagcaaaattgaagtcgagaacgacgcggtgaaagattctggcgagttgatcctgccgctctcgtaa

SEQ ID NO: 371 - DNA, 261 bp, Artificial Sequence
  coding sequence for PIP-72 polypeptide
atgggtattaccgttacaaacagctcgtccggcgacatcgaagtcgccatcaatcattggggtagcgacggagacacctccttctttaaggtcggcagcggcaagcaggaatcttgggacaggtccgacgatcgtggcttcgtgctttccctgaagaataatggcgcgcaacacccttactacgttcaggccagcagcaaaattgaagtcgagaacaactacgtgaaagattctggcgagttgatcgagccgctctcgtaa

SEQ ID NO: 372 - DNA, 261 bp, Artificial Sequence
  coding sequence for PIP-72 polypeptide
atgggtattaccgttacaaacaactcgtccggcccgatcgaagtcgccatcaatcattggggtagcgacggagacacccaattctttaaggtcgccccaggcaagcaggaatcttgggacaggtccgacgatcgtggcttcgtgctttccctgaagaataatggcgcgcaacacccttactacgttcaggccagcagcaaaattgaagtcgagaacgacgcggtgaaagattctggcgagttgatcgagccgctctcgtaa

SEQ ID NO: 373 - DNA, 261 bp, Artificial Sequence
  coding sequence for PIP-72 polypeptide
atgggtattaccgttacaaacagctcgtccggcgacatcgaagtcgccatcaatcattggggtagcgacggagacacccaattctttaaggtcggcagcggcaagcaggaaacttgggacaggtccgacgatcgtggcttcgtgctttccctgaagaataatggcgcgcaacacccttactacgttcaggccagcagcaaaattgaagtcgagaacgacgcggtgaaagattctggccagttgatcgagccgctctcgtaa

SEQ ID NO: 374 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagcgcaatggcgcgcaagcaccttactacgttcaggccagcagcaaaattgaagtcgacaacaacgccgtgaaagatcagggccggttgatcgagccgctctcgtaa

SEQ ID NO: 375 - DNA, 261 bp, Artificial Sequence
  coding sequence for PIP-72 polypeptide
atgggtattaccgttacaaacaattcgtccaacccgatcgaagtggccatcaatcactggggtagcgacggagacaccagcttcttttccgtcggtaacggcaagcaggaatcctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 376 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccagttgatccagccgctctcgtaa

SEQ ID NO: 377 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 378 - DNA, 261 bp, Artificial Sequence
  coding sequence for PIP-72 polypeptide
atgggtattaccgttacaaacaattcgtccaacccgatcgaagcggccatcaataaatggggtagcgacggagacaccagcttcttttccgtcggtaacggcaagcaggaaacctgggacaggtccgacagccgtggcttcgtgctttccctgaagcgcaatggcgcgcaagcaccttactacgttcaggccagcagcaaaattgaagtcgacaacaacgccgtgaaagatcagggccggttgatcgagccgctctcgtaa

SEQ ID NO: 379 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagttgacaacaacaccgtgaaagatcagggccggttgatcgagccgctctcgtaa

SEQ ID NO: 380 - DNA, 261 bp, Artificial Sequence
  coding sequence for PIP-72 polypeptide
atgggtattaccgttacaaacaattcgtccaaccccatcgaagtggccatcaatcactggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccgtttgatccacccggtgtcttaa

SEQ ID NO: 381 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgcaatggcgcgcaagcaccttactacgttcaggccagcagcaaaattgaagtcgacaacaacgccgtgaaagatcagggccgtttgatccacccggtgtcttaa

SEQ ID NO: 382 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 383 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaaacctgggacaggtccgacagccgtggcttcgtgctttccctgaagcgcaatggcgcgcaacacccttactacgttcaggcctccagcaaaattgaagttgacaacaacaccgtgaaagatcagggcgaattgatcgagccgctgtcttaa

SEQ ID NO: 384 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaatcctgggacaggtccgacagccgtggcttcgtgctttccctgaagcgcaatggcgcgcaagcaccttactacgttcaggccagcagcaaaattgaagtcgacaacaacgccgtgaaagatcagggccgtttgatcgagccggtgtcttaa

SEQ ID NO: 385 - DNA, 261 bp, Artificial Sequence
  coding sequence for PIP-72 polypeptide
atgggtattaccgttacaaacaattcgtccaacccgatcgaagtggccatcaatcactggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccgtttgatccacccgctgtcttaa

SEQ ID NO: 386 - DNA, 261 bp, Artificial Sequence
  coding sequence for PIP-72 polypeptide
atgggtattaccgttacaaacaattcgtccaagaaaatcgaagtggccatcaataaatggggtagcgacggagacaccagcttcttttccgtcggtaacggcaagcaggaaacctgggacaggtccgacagccgtggcttcgtgctttccctgaagaagaatggcgcgcaagcaccttactacgttcaggccagcagcaaaattgaagtcgacaacaacgccgtgaaagatcagggccggttgatcgagccgctctcgtaa

SEQ ID NO: 387 - DNA, 261 bp, Artificial Sequence
  coding sequence for PIP-72 polypeptide
atgggtattaccgttacaaacaattcgtccaagccgatcgaagtggccatcaatcactggggtagcgacggagacactagcttctttggcgttgataacggcaagcaggaatcctgggacaggtccgacagccgtggcttcgtgctttccctgaagcgcaatggcgcgcaacacccttactacgttcaggccaccagcaaaattgaagttgaaaacaacaccgtgaaagatcagggccgtttgatcgagccggtggcttaa

SEQ ID NO: 388 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccaccagcaaaattgaaattgacaacaacgccgtgaaagatcagggccggttgatcgagccgctctcgtaa

SEQ ID NO: 389 - DNA, 261 bp, Artificial Sequence
  coding sequence for PIP-72 polypeptide
atgggtattaccgttacaaacaattcgtccaacccgatcgaagcggccatcaataaatggggtagcgacggagacaccagcttctttagcattgatagcggcaagcaggaatcctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 390 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaatcctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 391 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaacaatggcgcgcaacacccttactacgttcaggccagcagcaaaattgaagtcgacaacaacgccgtgaaagatcagggccggttgatcgagccgctgtcttaa

SEQ ID NO: 392 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccgctgtcttaa

SEQ ID NO: 393 - DNA, 261 bp, Artificial Sequence
  coding sequence for PIP-72 polypeptide
atgggtattaccgttacaaacaattcgtccaacaaaatcgaagtggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 394 - DNA, 261 bp, Artificial Sequence
  coding sequence for PIP-72 polypeptide
atgggtattaccgttacaaacaattcgtccaacccgatcgaagtggccatcaatcactggggtagcgacggagacaccagcttctttggcgttggtagcggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 395 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaagcaccttactacgttcaggccagcagcaaaattgaagtcgacaacaacgccgtgaaagatcagggcgaattgatcgagccggtgtcttaa

SEQ ID NO: 396 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccggtggcttaa

SEQ ID NO: 397 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccgctgtcttaa

SEQ ID NO: 398 - DNA, 261 bp, Artificial Sequence
  coding sequence for PIP-72 polypeptide
atgggtattaccgttacaaacaattcgtccaagccgatcgaagtggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 399 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattggtagcggcaagcaggaatcctgggacaggtccgacagccgtggcttcgtgctttccctgaagaagaatggcgcgcaacacccttactacgttcaggccagcagcaaaattgaagttgacaacaacgccgtgaaagatcagggccgtttgatcgagccgctctcgtaa

SEQ ID NO: 400 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccactagcaaaattgaaattgaaaacaacacggtgaaagatcagggccggttgatcgagccgctctcgtaa

SEQ ID NO: 401 - DNA, 261 bp, Artificial Sequence
  coding sequence for PIP-72 polypeptide
atgggtattaccgttacaaacaattcgtccaaccccatcgaagtcgccatcaataaatggggtagcgacggagacaccagcttcttttccgtcggtaacggcaagcaggaaacctgggacaggtccgacagccgtggcttcgtgctttccctgaagcgtaatggcgcgcaagctccttactacgttcaggccactagcaaaattgaaattgaaaacaacacggtgaaagatcagggccggttgatcgagccgctctcgtaa

SEQ ID NO: 402 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 403 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 404 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 405 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaaacctgggacaggtccgacagccgtggcttcgtgctttccctgaagagtaatggcgcgcaacacccttactacgttcaggccagcagcaaaattgaagtcgacaacaacgccgtgaaagatcagggccggttgatcgagccgctctcgtaa

SEQ ID NO: 406 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaatcttgggacaggtccgacagccgtggcttcgtgctttccctgaagcgtaatggcgcgcaagctccttactacgttcaggccactagcaaaattgaaattgaaaacaacacggtgaaagatcagggccggttgatcgagccgctctcgtaa

SEQ ID NO: 407 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagaagaatggcgcgcaacacccttactacgttcaggccactagcaaaattgaaattgaaaacaacacggtgaaagatcagggccggttgatcgagccgctctcgtaa

SEQ ID NO: 408 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 409 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaatcttgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 410 - DNA, 261 bp, Artificial Sequence
  coding sequence for PIP-72 polypeptide
atgggtattaccgttacaaacaattcgtccaaccccatcgaagctgccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 411 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 412 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaatcttgggacaggtccgacagccgtggcttcgtgctttccctgaagaagaatggcgcgcaagctccttactacgttcaggccagcagcaaaattgaagtcgacaacaacgccgtgaaagatcagggccggttgatcgagccgctctcgtaa

SEQ ID NO: 413 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaagctccttactacgttcaggccagcagcaaaattgaagtcgacaacaacacggtgaaagatcagggccggttgatcgagccgctctcgtaa

SEQ ID NO: 414 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaacacccttactacgttcaggccagcagcaaaattgaagtcgacaacaacgccgtgaaagatcagggccggttgatcgagccgctctcgtaa

SEQ ID NO: 415 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 416 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaagctccttactacgttcaggccagcagcaaaattgaagtcgacaacaacgccgtgaaagatcagggccggttgatcgagccgctctcgtaa

SEQ ID NO: 417 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagaagaatggcgcgcaacacccttactacgttcaggccactagcaaaattgaaattgaaaacaacacggtgaaagatcagggccggttgatcgagccgctctcgtaa

SEQ ID NO: 418 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaatcttgggacaggtccgacagccgtggcttcgtgctttccctgaagaagaatggcgcgcaagctccttactacgttcaggccagcagcaaaattgaagtcgacaacaacgcggtgaaagatcagggccggttgatcgagccgctctcgtaa

SEQ ID NO: 419 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaaacctgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 420 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccactagcaaaattgaaattgaaaacaacacggtgaaagatcagggccggttgatcgagccgctctcgtaa

SEQ ID NO: 421 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaagctccttactacgttcaggccactagcaaaattgaaattgaaaacaacacggtgaaagatcagggccggttgatcgagccgctctcgtaa

SEQ ID NO: 422 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtagcggcaagcaggaatcttgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 423 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaagctccttactacgttcaggccagcagcaaaattgaaattgaaaacaacacggtgaaagatcagggccggttgatcgagccgctctcgtaa

SEQ ID NO: 424 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacacggtgaaagatcagggccggttgatcgagccgctctcgtaa

SEQ ID NO: 425 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaaacctgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 426 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagagtaatggcgcgcaagctccttactacgttcaggccagcagcaaaattgaagtcgacaacaacgccgtgaaagatcagggccggttgatcgagccgctctcgtaa

SEQ ID NO: 427 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggcgaattgatccacccggtcgcataa

SEQ ID NO: 428 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagcgtaatggcgcgcaagctccttactacgttcaggccactagcaaaattgaaattgaaaacaacacggtgaaagatcagggccggttgatcgagccgctctcgtaa

SEQ ID NO: 429 - DNA, 261 bp, Artificial Sequence
  coding sequence for PIP-72 polypeptide
atgggtattaccgttacaaacaattcgtccaaccccatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccgctggcttaa

SEQ ID NO: 430 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatcgagccggtgtcttaa

SEQ ID NO: 431 - DNA, 261 bp, Artificial Sequence
  coding sequence for PIP-72 polypeptide
atgggtattaccgttacaaacaattcgtccaaccccatcgaagtggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 432 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccggtgtcttaa

SEQ ID NO: 433 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 434 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccggtggcttaa

SEQ ID NO: 435 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaagcaccttactacgttcaggccagcagcaaaattgaagtcgacaacaacgccgtgaaagatcagggcgaattgatcgagccggtggcttaa

SEQ ID NO: 436 - DNA, 261 bp, Artificial Sequence
  coding sequence for PIP-72 polypeptide
atgggtattaccgttacaaacaattcgtccaagaaaatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 437 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccgctggcttaa

SEQ ID NO: 438 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 439 - DNA, 261 bp, Artificial Sequence
  coding sequence for PIP-72 polypeptide
atgggtattaccgttacaaacaattcgtccaagccgatcgaagcggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 440 - DNA, 261 bp, Artificial Sequence
  coding sequence for PIP-72 polypeptide
atgggtattaccgttacaaacaattcgtccaacaaaatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 441 - DNA, 261 bp, Artificial Sequence
  coding sequence for PIP-72 polypeptide
atgggtattaccgttacaaacaattcgtccaacaaaatcgaagcggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 442 - DNA, 261 bp, Artificial Sequence
  coding sequence for PIP-72 polypeptide
atgggtattaccgttacaaacaattcgtccaacaaaatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 443 - DNA, 261 bp, Artificial Sequence
  coding sequence for PIP-72 polypeptide
atgggtattaccgttacaaacaattcgtccaacccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 444 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccgctgtcttaa

SEQ ID NO: 445 - DNA, 261 bp, Artificial Sequence
  coding sequence for PIP-72 polypeptide
atgggtattaccgttacaaacaattcgtccaacccgatcgaagtggccatcaataaatggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 446 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccggtgtcttaa

SEQ ID NO: 447 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 448 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgatagcggcaagcaggaatcctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 449 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcattgataacggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccggtgtcttaa

SEQ ID NO: 450 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggcgaattgatcgagccgctggcttaa

SEQ ID NO: 451 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttggtagcggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccgctggcttaa

SEQ ID NO: 452 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttgataacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggcgaattgatccacccgctgtcttaa

SEQ ID NO: 453 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgatagcggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 454 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 455 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggcgaattgatcgagccgctggcttaa

SEQ ID NO: 456 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 457 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgatagcggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 458 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcacaatggcgcgcaacccccttactacgttcaggccagcagcaaaattgaagtcgacaacaacgccgtgaaagatcagggccgtttgatccacccgctcgcttaa

SEQ ID NO: 459 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttgatagcggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccgtttgatcgagccggtggcttaa

SEQ ID NO: 460 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 461 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaatcctgggacaggtccgacagccgtggcttcgtgctttccctgaagcgcaatggcgcgcaagcaccttactacgttcaggccagcagcaaaattgaagtcgacaacaacgccgtgaaagatcagggcgaattgatcgagccgctgtcttaa

SEQ ID NO: 462 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattggtagcggcaagcaggaatcctgggacaggtccgacagccgtggcttcgtgctttccctgaagcgcaatggcgcgcaagcaccttactacgttcaggccagcagcaaaattgaagtcgacaacaacgccgtgaaagatcagggcgaattgatcgagccggtgtcttaa

SEQ ID NO: 463 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttgataacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 464 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttgatagcggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatcgagccggtggcttaa

SEQ ID NO: 465 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattggtaacggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 466 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttgatagcggcaagcaggaatcctgggacaggtccgacagccgtggcttcgtgctttccctgaagaagaatggcgcgcaagcaccttactacgttcaggccagcagcaaaattgaagtcgacaacaacgccgtgaaagatcagggccggttgatcgagccgctctcgtaa

SEQ ID NO: 467 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttggtagcggcaagcaggaaacctgggacaggtccgacagccgtggcttcgtgctttccctgaagaagaatggcgcgcaagcaccttactacgttcaggccagcagcaaaattgaagtcgacaacaacgccgtgaaagatcagggccggttgatcgagccgctctcgtaa

SEQ ID NO: 468 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 469 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcactcaagcaccttactacgttcaggccaccagcaaaattgaaattgaaaactctaccgtgaaagatcatggcgaaaccatccacccggtagcataa

SEQ ID NO: 470 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcgcgcaagcaccttactacgttcaggccaccagcaaaattgaaattgaaaactctaccgtgaaagatcatggcgaaaccatccacccggtagcataa

SEQ ID NO: 471 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcgcgcaagcaccttactacgttcaggccaccagcaaaattgaaattgaaaactctaccgtgaaagatcagggccgtttgatccacccggtgtcttaa

SEQ ID NO: 472 - DNA, 261 bp, Artificial Sequence
  coding sequence for PIP-72 polypeptide
atgggtattaccgttacaaacaattcgtccaagccgatcgaagcggccatcaatcactggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 473 - DNA, 261 bp, Artificial Sequence
  coding sequence for PIP-72 polypeptide
atgggtattaccgttacaaacaattcgtccaagccgatcgaagcggccatcaataaatggggtagcgacggagacaccaaattctttggcatcgatagcggcaagcaggaatcctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 474 - DNA, 261 bp, Artificial Sequence
  coding sequence for PIP-72 polypeptide
atgggtattaccgttacaaacaattcgtccaagccgatcgaagcggccatcaataaatggggtagcgacggagacaccaaattctttggcatcgatagcggcaagcaggaatcctgggacaggtccgacgaccgtggcttcgtgctttccctgaagcgtaatggcgcgcaagcaccttactacgttcaggccaccagcaaaattgaaattgaaaactctaccgtgaaagatcagggcgaattgatccacccggtgtcttaa

SEQ ID NO: 475 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgtaatggcgcgcaacacccttactacgttcaggccaccagcaaaattgaaattgaaaactctaccgtgaaagatcatggcgaattgatcgagccggtggcttaa

SEQ ID NO: 476 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 477 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcagggcgaattgatcgagccgctggcttaa

SEQ ID NO: 478 - DNA, 261 bp, Artificial Sequence
  coding sequence for PIP-72 polypeptide
atgggtattaccgttacaaacaattcgtccaacaaaatcgaagcggccatcaataaatggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 479 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaagcaccttactacgttcaggccaccagcaaaattgaaattgaaaactctaccgtgaaagatcagggcgaattgatccacccggtggcttaa

SEQ ID NO: 480 - DNA, 261 bp, Artificial Sequence
  coding sequence for PIP-72 polypeptide
atgggtattaccgttacaaacaaatcgtccaaaaaaatcgaagctagcatcaataaatggggtagagacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcagggccgtttgatccacccggtggcttaa

SEQ ID NO: 481 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttagcattggtagcggcaagcaggaaacctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 482 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttggtagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 483 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttgatagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 484 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 485 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacagccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 486 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttggtagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 487 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttagcattgatagcggcaagcaggaaacctgggacaggtccgacgaccgtggcttcgtgctttccctgaagcgcaatggcgcgcaacacccttactacgttcaggccaccaacaaaattgaaattgaaaactctaccgtgaaagatcatggcgaaaccatccacccggtagcataa

SEQ ID NO: 488 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 489 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacagccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 490 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacgaccgtggcttcgtgctttccctgaagcgcaatggcgcgcaagcaccttactacgttcaggccaccagcaaaattgaaattgaaaactctaccgtgaaagatcagggcgaattgatccacccggtgtcttaa

SEQ ID NO: 491 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcgttggtagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcagggcgaattgatcgagccgctgtcttaa

SEQ ID NO: 492 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttgatagcggcaagcaggaaacctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 493 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcagggcgaattgatccacccggtggcttaa

SEQ ID NO: 494 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttagcgttggtagcggcaagcaggaaacctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 495 - DNA, 261 bp, Artificial Sequence
  coding sequence for PIP-72 polypeptide
atgggtattaccgttacaaacaattcgtccaacccgatcgaagtggccatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 496 - DNA, 261 bp, Artificial Sequence
  coding sequence for PIP-72 polypeptide
atgggtattaccgttacaaacaattcgtccaacaaaatcgaagcggccatcaataaatggggtagcgacggagacaccaaattctttggcatcgatagcggcaagcaggaatcctgggacaggtccgacgaccgtggcttcgtgctttccctgaagcgtaatggcgcgcaagcaccttactacgttcaggccaccagcaaaattgaaattgaaaactctaccgtgaaagatcatggcgaaaccatccacccggtagcataa

SEQ ID NO: 497 - DNA, 261 bp, Artificial Sequence
  coding sequence for PIP-72 polypeptide
atgggtattaccgttacaaacaattcgtccaacccgatcgaagtggccatcaataaatggggtagcgacggagacaccaaattctttggcatcgatagcggcaagcaggaatcctgggacaggtccgacgaccgtggcttcgtgctttccctgaagcgtaatggcactcaagcaccttactacgttcaggcctccagcaaaattgaaattgaaaacaacgccgtgaaagatcagggcgaaaccatccacccggtagcataa

SEQ ID NO: 498 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcgcgcaagcaccttactacgttcaggccaccagcaaaattgaaattgaaaactctaccgtgaaagatcagggcgaattgatccacccgctggcttaa

SEQ ID NO: 499 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 500 - DNA, 261 bp, Artificial Sequence
  coding sequence for PIP-72 polypeptide
atgggtattaccgttacaaacaattcgtccaagaaaatcgaagcggccatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 501 - DNA, 261 bp, Artificial Sequence
  coding sequence for PIP-72 polypeptide
atgggtattaccgttacaaacaattcgtccaagccaatcgaagcggccatcaatcactggggtagcgacggagacaccaaattctttggcatcgatagcggcaagcaggaatcctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 502 - DNA, 261 bp, Artificial Sequence
  coding sequence for PIP-72 polypeptide
atgggtattaccgttacaaacaattcgtccaagccgatcgaagcggccatcaatcactggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 503 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcattgatagcggcaagcaggaatcctgggacaggtccgacgaccgtggcttcgtgctttccctgaagaagaatggcgcgcaagcaccttactacgttcaggccaccagcaaaattgaaattgaaaactctaccgtgaaagatcatggcgaaaccatccacccggtagcataa

SEQ ID NO: 504 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaagttgaaaacaacgccgtgaaagatcatggcgaaaccatccacccggtagcataa

SEQ ID NO: 505 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgacaacaacaccgtgaaagatcatggcgaaaccatccacccggtagcataa

SEQ ID NO: 506 - DNA, 261 bp, Artificial Sequence
  coding sequence for PIP-72 polypeptide
atgggtattaccgttacaaacaattcgtccaagaaaatcgaagcggccatcaatcactggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 507 - DNA, 261 bp, Artificial Sequence
  coding sequence for PIP-72 polypeptide
atgggtattaccgttacaaacaattcgtccaagccgatcgaagcggccatcaataaatggggtagcgacggagacaccaaattctttggcatcgatagcggcaagcaggaatcctgggacaggtccgacgaccgtggcttcgtgctttccctgaagcgtaatggcgcgcaagcaccttactacgttcaggccaccagcaaaattgaaattgaaaactctaccgtgaaagatcagggccgtttgatccacccgctgtcttaa

SEQ ID NO: 508 - DNA, 261 bp, Artificial Sequence
  coding sequence for PIP-72 polypeptide
atgggtattaccgttacaaacaattcgtccaagccgatcgaagcggccatcaataaatggggtagcgacggagacaccagcttctttagcgttgatagcggcaagcaggaaacctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 509 - DNA, 261 bp, Artificial Sequence
  coding sequence for PIP-72 polypeptide
atgggtattaccgttacaaacaaatcgtccaaaaaaatcgaagcggccatcaataaatggggtagcgacggagacaccagcttctttggcgttggtagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtggcttaa

SEQ ID NO: 510 - DNA, 261 bp, Artificial Sequence
  coding sequence for PIP-72 polypeptide
atgggtattaccgttacaaacaattcgtccaacccgatcgaagtggccatcaataaatggggtagcgacggagacaccaaattctttggcattggtagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 511 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagagcaatggcgcgcaagcaccttactacgttcaggccaccagcaaaattgaaattgaaaactctaccgtgaaagatcatggcgaaaccatccacccggtagcataa

SEQ ID NO: 512 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttggtagcggcaagcaggaaacctgggacaggtccgacgaccgtggcttcgtgctttccctgaagaagaatggcgcgcaacacccttactacgttcaggccaccagcaaaattgaaattgaaaactctaccgtgaaagatcagggcgaaaccatccacccggtagcataa

SEQ ID NO: 513 - DNA, 261 bp, Artificial Sequence
  coding sequence for PIP-72 polypeptide
atgggtattaccgttacaaacaaatcgtccaaaaaaatcgaagcggccatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggcctccagcaaaattgaaattgaaaacaacaccgtgaaagatcatggcgaaaccatccacccggtagcataa

SEQ ID NO: 514 - DNA, 261 bp, Artificial Sequence
  coding sequence for PIP-72 polypeptide
atgggtattaccgttacaaacaaatcgtccaaaaaaatcgaagctagcatcaatcactggggtagcgacggagacaccagcttctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 515 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaacaacgccgtgaaagatcagggccgtttgatcgagccggtggcttaa

SEQ ID NO: 516 - DNA, 261 bp, Artificial Sequence
  coding sequence for PIP-72 polypeptide
atgggtattaccgttacaaacaattcgtccaagccgatcgaagtggccatcaatcactggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 517 - DNA, 261 bp, Artificial Sequence
  coding sequence for PIP-72 polypeptide
atgggtattaccgttacaaacaaatcgtccaaaaaaatcgaagcggccatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 518 - DNA, 261 bp, Artificial Sequence; identical to SEQ ID NO: 473
  coding sequence for PIP-72 polypeptide

SEQ ID NO: 519 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcagggcgaattgatccacccggtgtcttaa

SEQ ID NO: 520 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 521 - DNA, 261 bp, Artificial Sequence
  coding sequence for PIP-72 polypeptide
atgggtattaccgttacaaacaattcgtccaagaaaatcgaagtggccatcaatcactggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 522 - DNA, 261 bp, Artificial Sequence; identical to SEQ ID NO: 476
  coding sequence for PIP-72 polypeptide

SEQ ID NO: 523 - DNA, 261 bp, Artificial Sequence
  coding sequence for PIP-72 polypeptide
atgggtattaccgttacaaacaattcgtccaagaaaatcgaagtggccatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 524 - DNA, 261 bp, Artificial Sequence
  coding sequence for PIP-72 polypeptide
atgggtattaccgttacaaacaaatcgtccaaaaaaatcgaagctagcatcaatcactggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 525 - DNA, 261 bp, Artificial Sequence
  coding sequence for PIP-72 polypeptide
atgggtattaccgttacaaacaattcgtccaagaaaatcgaagtggccatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 526 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacgaccgtggcttcgtgctttccctgaagaagaatggcgcgcaagcaccttactacgttcaggccaccagcaaaattgaaattgaaaactctaccgtgaaagatcatggcgaaaccatccacccggtagcataa

SEQ ID NO: 527 - DNA, 261 bp, Artificial Sequence
  coding sequence for PIP-72 polypeptide
atgggtattaccgttacaaacaaatcgtccaaaaaaatcgaagtggccatcaatcactggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 528 - protein, 86 aa, Artificial Sequence
  PIP-72 polypeptide
MAISVKNNASNPVEVAINHWGTDGDTKPFSVAPGASDSWDRNDLRGFVMYVQLGGSAHPYYVLSTSNIVIYDDKVTDSGQTLLPLS

SEQ ID NO: 529 - protein, 86 aa, Artificial Sequence
  PIP-72 polypeptide
MAISVKNSASNTVEVSINHWGTDGDTKPFKMAPGASDTWDRNDLRGFVMYVQLGGSATPYYVLSTSNIVIYDDKVTDSGQTLLPLS

SEQ ID NO: 530 - protein, 86 aa, Artificial Sequence
  PIP-72 polypeptide
MAITVKNSASNTIEVSINHWGTDGDTKPFKVAPGASETWDRNDLRGFVLYVQLGGSATPYYVLSSSNIVIYDDKVTDSGQTILPLS

SEQ ID NO: 531 - protein, 86 aa, Artificial Sequence
  PIP-72 polypeptide
MAITVKNSASNTIEVSINHWGSDGDTKPFKVAPGASETWDRNDLRGFVLYLQLGGSATPYYVLSTSNIVIYDDKVTDSGQTILPLS

SEQ ID NO: 532 - protein, 86 aa, Artificial Sequence
  PIP-72 polypeptide
MAISVTNNASNPVEVAINHWGTDGDTSFFSVANGKQDSWDRSDLRGFVMSVQKNGAQHPYYVLSTSNIVIYDDKVTDSGQTLLPLS

SEQ ID NO: 533 - protein, 86 aa, Artificial Sequence
  PIP-72 polypeptide
MAISVKNSASNTVEVAINHWGTDGDTKPFKVAPGASETWDRNDLRGFVLYVQLGGSATPYYVLSSSNIVIYDDKVTDSGQTILPLS

SEQ ID NO: 534 - protein, 86 aa, Artificial Sequence
  PIP-72 polypeptide
MAITVKNSASNTVEVAINHWGTDGDTKPFKVAPGASETWDRNDLRGFVLYVQLGGSATPYYVLSSSNIVIYDDKVTDSGQTILPLS

SEQ ID NO: 535 - protein, 86 aa, Artificial Sequence
  PIP-72 polypeptide
MAITVKNSASNTIEVAINHWGTDGDTKPFKVAPGASETWDRNDLRGFVMYVKLGGSATPYYVLSSSNIVIYDDKVTDSGQTILPLS

SEQ ID NO: 536 - protein, 86 aa, Artificial Sequence
  PIP-72 polypeptide
MAITVKNSASNTIEVSINHWGTDGDTKPFKVAPGASETWDRNDLRGFVMYVQLGGSATPYYVLSSSNIVIYDDKVTDSGQTILPLS

SEQ ID NO: 537 - protein, 86 aa, Artificial Sequence
  PIP-72 polypeptide
MAITVKNSASNTIEVSINHWGTDGDTKPFKVAPGASDSWDRNDLRGFVLYVQLGGSATPYYVLSSSNIVIYDDKVTDSGQTILPLS

SEQ ID NO: 538 - protein, 86 aa, Artificial Sequence
  PIP-72 polypeptide
MAISVKNSSSNTIEVAINHWGTDGDTKPFKVAPGASETWDRNDLRGFVLYVQLGGSATPYYVLSSSNIVIYDDKVTDSGQTILPLS

SEQ ID NO: 539 - protein, 86 aa, Artificial Sequence
  PIP-72 polypeptide
MAITVKNNSSNTIEVSINHWGTDGDTKPFKMAPGASESWDRNDLRGFVMYVQLGGSATPYYVLSTSNIVIYDDKVTDSGQTLLPLS

SEQ ID NO: 540 - protein, 86 aa, Artificial Sequence
  PIP-72 polypeptide
MAITVKNNASNTIEVAINHWGTDGDTKPFKMAPGASESWDRNDLRGFVLYVQLGGSATPYYVLSTSNIVIYDDKVTDSGQTLLPLS

SEQ ID NO: 541 - protein, 86 aa, Artificial Sequence
  PIP-72 polypeptide
MAISVKNNASNTVEVSINHWGTDGDTKPFKMAPGASDTWDRNDLRGFVMYVQLGGSATPYYVLSTSNIVIYDDKVTDSGQTLLPLS

SEQ ID NO: 542 - protein, 86 aa, Artificial Sequence
  PIP-72 polypeptide
MAISVKNSASNTVEVSINHWGTDGDTKPFKMAPGASESWDRNDLRGFVMYVQLGGSATPYYVLSTSNIVIYDDKVTDSGQTLLPLS

SEQ ID NO: 543 - protein, 86 aa, Artificial Sequence
  PIP-72 polypeptide
MAISVKNSSSNTIEVSINHWGTDGDTKPFKMAPGASDTWDRNDLRGFVMYVQLGGSATPYYVLSTSNIVIYDDKVTDSGQTLLPLS

SEQ ID NO: 544 - protein, 86 aa, Artificial Sequence
  PIP-72 polypeptide
MAISVKNSASNTVEVSINHWGTDGDTKPFKMAPGASDTWDRNDLRGFVLYVQLGGSATPYYVLSTSNIVIYDDKVTDSGQTLLPLS

SEQ ID NO: 545 - protein, 86 aa, Artificial Sequence
  PIP-72 polypeptide
MAITVKNSSSNTIEVAINHWGTDGDTKPFKMAPGASETWDRNDLRGFVMYVQLGGSATPYYVLSTSNIVIYDDKVTDSGQTLLPLS

SEQ ID NO: 546 - protein, 86 aa, Artificial Sequence
  PIP-72 polypeptide
MAISVKNSASNTVEVSINHWGTDGDTKPFKMAPGASDSWDRNDLRGFVMYVQLGGSATPYYVLSTSNIVIYDDKVTDSGQTLLPLS

SEQ ID NO: 547 - protein, 86 aa, Artificial Sequence
  PIP-72 polypeptide
MAISVKNSSSNTIEVSINHWGTDGDTKPFKMAPGASETWDRNDLRGFVMYVQLGGSATPYYVLSTSNIVIYDDKVTDSGQTLLPLS

SEQ ID NO: 548 - protein, 86 aa, Artificial Sequence
  PIP-72 polypeptide
MAISVKNSASNTVEVSINHWGTDGDTKPFKMAPGASETWDRNDLRGFVLYVQLGGSATPYYVLSTSNIVIYDDKVTDSGQTLLPLS

SEQ ID NO: 549 - protein, 86 aa, Artificial Sequence
  PIP-72 polypeptide
MAITVKNSASNTVEVSINHWGTDGDTKPFKMAPGASESWDRNDLRGFVMYVQLGGSATPYYVLSTSNIVIYDDKVTDSGQTLLPLS

SEQ ID NO: 550 - protein, 86 aa, Artificial Sequence
  PIP-72 polypeptide
MAISVKNSASNTIEVSINHWGTDGDTKPFKMAPGASESWDRNDLRGFVMYVQLGGSATPYYVLSTSNIVIYDDKVTDSGQTLLPLS

SEQ ID NO: 551 - protein, 86 aa, Artificial Sequence
  PIP-72 polypeptide
MAISVKNSASNTVEVSINHWGTDGDTKPFKMAPGASETWDRNDLRGFVMYVQLGGSATPYYVLSTSNIVIYDDKVTDSGQTLLPLS

SEQ ID NO: 552 - protein, 86 aa, Artificial Sequence
  PIP-72 polypeptide
MAISVKNSASNTVEVSINHWGTDGDTKPFKMAPGASDSWDRNDLRGFVLYVQLGGSATPYYVLSTSNIVIYDDKVTDSGQTLLPLS

SEQ ID NO: 553 - protein, 86 aa, Artificial Sequence
  PIP-72 polypeptide
MAITVKNNASNTVEVAINHWGTDGDTKPFKMAPGASETWDRNDLRGFVMYVQLGGSATPYYVLSTSNIVIYDDKVTDSGQTLLPLS

SEQ ID NO: 554 - protein, 86 aa, Artificial Sequence
  PIP-72 polypeptide
MAISVKNNSSNTIEVSINHWGTDGDTKPFKMAPGASDSWDRNDLRGFVMYVQLGGSATPYYVLSTSNIVIYDDKVTDSGQTLLPLS

SEQ ID NO: 555 - protein, 86 aa, Artificial Sequence
  PIP-72 polypeptide
MAISVKNSASNTIEVSINHWGTDGDTKPFKMAPGASDSWDRNDLRGFVMYVQLGGSATPYYVLSTSNIVIYDDKVTDSGQTLLPLS

SEQ ID NO: 556 - protein, 86 aa, Artificial Sequence
  PIP-72 polypeptide
MAISVKNSSSNTVEVAINHWGTDGDTKPFKMAPGASDSWDRNDLRGFVLYVQLGGSATPYYVLSTSNIVIYDDKVTDSGQTLLPLS

SEQ ID NO: 557 - protein, 86 aa, Artificial Sequence
  PIP-72 polypeptide
MAITVKNSASNTIEVAINHWGTDGDTKPFKMAPGASDTWDRNDLRGFVMYVQLGGSATPYYVLSTSNIVIYDDKVTDSGQTLLPLS

SEQ ID NO: 558 - protein, 86 aa, Artificial Sequence; identical to SEQ ID NO: 544
  PIP-72 polypeptide

SEQ ID NO: 559 - protein, 86 aa, Artificial Sequence
  PIP-72 polypeptide
MAISVKNNSSNTVEVAINHWGTDGDTKPFKMAPGASESWDRNDLRGFVMYVQLGGSATPYYVLSTSNIVIYDDKVTDSGQTLLPLS

SEQ ID NO: 560 - protein, 86 aa, Artificial Sequence
  PIP-72 polypeptide
MAISVKNSSSNTVEVAINHWGTDGDTKPFKMAPGASESWDRNDLRGFVMYVQLGGSATPYYVLSTSNIVIYDDKVTDSGQTLLPLS

SEQ ID NO: 561 - protein, 86 aa, Artificial Sequence
  PIP-72 polypeptide
MAITVKNSASNTVEVAINHWGTDGDTKPFKMAPGASDTWDRNDLRGFVMYVKLGGSATPYYVLSTSNIVIYDDKVTDSGQTLLPLS

SEQ ID NO: 562 - protein, 86 aa, Artificial Sequence
  PIP-72 polypeptide
MAISVKNSASNTVEVSINHWGTDGDTKPFKMAPGASDTWDRNDLRGFVLYVKLGGSATPYYVLSTSNIVIYDDKVTDSGQTLLPLS

SEQ ID NO: 563 - protein, 86 aa, Artificial Sequence
  PIP-72 polypeptide
MAISVKNSSSNTVEVSINHWGTDGDTKPFKMAPGASDTWDRNDLRGFVLYVQLGGSATPYYVLSTSNIVIYDDKVTDSGQTLLPLS

SEQ ID NO: 564 - protein, 86 aa, Artificial Sequence
  PIP-72 polypeptide
MAISVTNSASNPVEVAINHWGTDGDTSFFSVANGKQESWDRSDLRGFVMSVKKNGAQHPYYVLSTSNIVIYDDKVTDSGQTLLPLS

SEQ ID NO: 565 - protein, 86 aa, Artificial Sequence
  PIP-72 polypeptide
MAISVTNNASNPVEVAINHWGTDGDTSFFSVANGKQDSWDRSDLRGFVMSVQKNGAQHPYYVLSTSNIVIYDDKVTDSGQLILPLS

SEQ ID NO: 566 - protein, 86 aa, Artificial Sequence
  PIP-72 polypeptide
MAISVTNNASNPIEVAINHWGTDGDTSFFSVANGKQESWDRSDLRGFVMSVQKNGAQHPYYVLSTSNIVIYDDKVTDSGQTLLPLS

SEQ ID NO: 567 - protein, 86 aa, Artificial Sequence
  PIP-72 polypeptide
MAISVTNNASNPVEVAINHWGTDGDTSFFSVANGKQDSWDRSDLRGFVMSVKKNGAQHPYYVLSTSNIVIYDDKVTDSGQTLLPLS

SEQ ID NO: 568 - protein, 86 aa, Artificial Sequence
  PIP-72 polypeptide
MAISVTNNASNPIEVAINHWGTDGDTSFFSVANGKQETWDRSDLRGFVMSVQKNGAQHPYYVLSTSNIVIYDDKVTDSGQTLLPLS

SEQ ID NO: 569 - protein, 86 aa, Artificial Sequence
  PIP-72 polypeptide
MAISVTNSASNPVEVAINHWGTDGDTSFFSVANGKQDSWDRSDLRGFVMSVQKNGAQHPYYVLSTSNIVIYDDKVTDSGQTLLPLS

SEQ ID NO: 570 - protein, 86 aa, Artificial Sequence
  PIP-72 polypeptide
MAISVTNNASNPVEVAINHWGTDGDTSFFSVANGKQETWDRSDLRGFVLSVQKNGAQHPYYVLSTSNIVIYDDKVTDSGQTLLPLS

SEQ ID NO: 571 - protein, 86 aa, Artificial Sequence
  PIP-72 polypeptide
MAISVTNNASNPVEVAINHWGTDGDTSFFSVANGKQESWDRSDLRGFVLSVQKNGAQHPYYVLSTSNIVIYDDKVTDSGQTLLPLS

SEQ ID NO: 572 - protein, 86 aa, Artificial Sequence
  PIP-72 polypeptide
MAISVTNNASNPVEVSINHWGTDGDTSFFSVANGKQDSWDRSDLRGFVMSVQKNGAQHPYYVLSTSNIVIYDDKVTDSGQTLLPLS

SEQ ID NO: 573 - protein, 86 aa, Artificial Sequence
  PIP-72 polypeptide
MAISVTNNASNPVEVAINHWGTDGDTSFFSVANGKQDSWDRSDLRGFVMSVQKNGAQHPYYVLSTSNIVIYDDKVTDSGQTLEPLS

SEQ ID NO: 574 - protein, 86 aa, Artificial Sequence
  PIP-72 polypeptide
MAISVTNNASNPVEVAINHWGTDGDTSFFSVANGKQETWDRSDLRGFVMSVQKNGAQHPYYVLSTSNIVIYDDKVTDSGQTLLPLS

SEQ ID NO: 575 - protein, 86 aa, Artificial Sequence
  PIP-72 polypeptide
MAISVTNNASNPVEVAINHWGTDGDTSFFSVANGKQESWDRSDLRGFVMSVQKNGAQHPYYVLSTSNIVIYDDKVTDSGQTLLPLS

SEQ ID NO: 576 - protein, 86 aa, Artificial Sequence
  PIP-72 polypeptide
MAISVTNNSSNPIEVAINHWGTDGDTSFFSVANGKQDSWDRSDLRGFVLSVKKNGAQHPYYVLSTSNIVIYDDKVTDSGQTLLPLS

SEQ ID NO: 577 - protein, 86 aa, Artificial Sequence
  PIP-72 polypeptide
MAISVTNNSSNPIEVAINHWGTDGDTSFFSVANGKQDTWDRSDLRGFVMSVQKNGAQHPYYVLSTSNIVIYDDKVTDSGQTLLPLS

SEQ ID NO: 578 - protein, 86 aa, Artificial Sequence
  PIP-72 polypeptide
MAISVTNNASNPIEVAINHWGTDGDTSFFSVANGKQDSWDRSDLRGFVMSVQKNGAQHPYYVLSTSNIVIYDDKVTDSGQTLLPLS

SEQ ID NO: 579 - protein, 86 aa, Artificial Sequence
  PIP-72 polypeptide
MAISVTNSASNPVEVSINHWGTDGDTSFFSVANGKQDTWDRSDLRGFVMSVQKNGAQHPYYVLSTSNIVIYDDKVTDSGQTLLPLS

SEQ ID NO: 580 - protein, 86 aa, Artificial Sequence
  PIP-72 polypeptide
MAISVTNNASNPVEVSINHWGTDGDTSFFSVANGKQETWDRSDLRGFVMSVQKNGAQHPYYVLSTSNIVIYDDKVTDSGQTILPLS

SEQ ID NO: 581 - protein, 86 aa, Artificial Sequence; identical to SEQ ID NO: 575
  PIP-72 polypeptide

SEQ ID NO: 582 - protein, 86 aa, Artificial Sequence
  PIP-72 polypeptide
MAITVTNNSSNPVEVAINHWGTDGDTSFFSVANGKQETWDRSDLRGFVLSVKKNGAQHPYYVLSTSNIVIYDDKVTDSGQTLLPAS

SEQ ID NO: 583 - protein, 86 aa, Artificial Sequence
  PIP-72 polypeptide
MAISVTNNASNPVEVSINHWGTDGDTSFFSVANGKQETWDRSDLRGFVMSVKKNGAQHPYYVLSTSNIVIYDDKVTDSGQTLLPLS

SEQ ID NO: 584 - protein, 86 aa, Artificial Sequence
  PIP-72 polypeptide
MAISVTNNASNPIEVAINHWGTDGDTSFFSVANGKQESWDRSDLRGFVMSVQKNGAQHPYYVLSTSNIVIYDDKVTDSGQLILPAS

SEQ ID NO: 585 - protein, 86 aa, Artificial Sequence
  PIP-72 polypeptide
MAISVTNNASNPVEVSINHWGTDGDTSFFSVANGKQDSWDRSDLRGFVMSVQKNGAQHPYYVLSTSNIVIYDDKVTDSGQLIEPLS

SEQ ID NO: 586 - protein, 86 aa, Artificial Sequence
  PIP-72 polypeptide
MAISVTNNSSNPIEVAINHWGTDGDTSFFSVANGKQDSWDRSDLRGFVMSVQKNGAQHPYYVLSTSNIVIYDDKVTDSGQTLLPLS

SEQ ID NO: 587 - protein, 86 aa, Artificial Sequence; identical to SEQ ID NO: 566
  PIP-72 polypeptide

SEQ ID NO: 588 - protein, 86 aa, Artificial Sequence
  PIP-72 polypeptide
MAISVTNSASNPVEVAINHWGTDGDTSFFSVANGKQETWDRSDLRGFVMSVQKNGAQHPYYVLSTSNIVIYDDKVTDSGQTLLPLS

SEQ ID NO: 589 - protein, 86 aa, Artificial Sequence
  PIP-72 polypeptide
MAISVTNNASNPIEVSINHWGTDGDTSFFSVANGKQETWDRSDLRGFVMSVQKNGAQHPYYVLSTSNIVIYDDKVTDSGQTLEPLS

SEQ ID NO: 590 - protein, 86 aa, Artificial Sequence
  PIP-72 polypeptide
MAISVTNNASNPVEVAINHWGTDGDTSFFSVANGKQDSWDRSDLRGFVMSVKKNGAQHPYYVLSTSNIVIYDDKVTDSGQTILPLS

SEQ ID NO: 591 - protein, 86 aa, Artificial Sequence
  PIP-72 polypeptide
MAISVTNNASNPVEVAINHWGTDGDTSFFSVANGKQDTWDRSDLRGFVMSVQKNGAQHPYYVLSTSNIVIYDDKVTDSGQTFVPVS

SEQ ID NO: 592 - protein, 86 aa, Artificial Sequence
  PIP-72 polypeptide
MAITVTNSASNPVEVAINHWGTDGDTSFFSVANGKQDSWDRSDLRGFVMSVQKNGAQHPYYVLSTSNIVIYDDKVTDSGQTLLPLS

SEQ ID NO: 593 - protein, 86 aa, Artificial Sequence
  PIP-72 polypeptide
MAISVTNNASNPVEVAINHWGTDGDTSFFSVANGKQDTWDRSDLRGFVMSVQKNGAQHPYYVLSTSNIVIYDDKVTDSGQTLLPLS

SEQ ID NO: 594 - protein, 86 aa, Artificial Sequence
  PIP-72 polypeptide
MAISVTNSSSNPVEVAINHWGTDGDTSFFSVANGKQDSWDRSDLRGFVMSVQKNGAQHPYYVLSTSNIVIYDDKVTDSGQTLLPLS

SEQ ID NO: 595 - protein, 86 aa, Artificial Sequence
  PIP-72 polypeptide
MAISVTNNASNPIEVAINHWGTDGDTSFFSVANGKQDSWDRSDLRGFVMSVKKNGAQHPYYVLSTSNIVIYDDKVTDSGQTLLPLS

SEQ ID NO: 596 - protein, 86 aa, Artificial Sequence
  PIP-72 polypeptide
MAISVTNNASNPVEVAINHWGTDGDTSFFSVANGKQESWDRSDLRGFVMSVQKNGAQHPYYVLSTSNIVIYDDKVTDSGQLIEPLS

SEQ ID NO: 597 - protein, 86 aa, Artificial Sequence
  PIP-72 polypeptide
MAISVTNNASNPVEVAINHWGTDGDTSFFSVANGKQESWDRSDLRGFVLSVKKNGAQHPYYVLSTSNIVIYDDKVTDSGQLIEPLS

SEQ ID NO: 598 - protein, 86 aa, Artificial Sequence
  PIP-72 polypeptide
MAITVTNNASNPVEVSINHWGTDGDTSFFSVANGKQESWDRSDLRGFVMSVQKNGAQHPYYVLSTSNIVIYDDKVTDSGQTLLPLN

SEQ ID NO: 599 - protein, 86 aa, Artificial Sequence
  PIP-72 polypeptide
MAITVTNSASNPVEVAINHWGTDGDTSFFSVANGKQDSWDRSDLRGFVMSVKKNGAQHPYYVLSTSNIVIYDDKVTDSGQTLLPLS

SEQ ID NO: 600 - protein, 86 aa, Artificial Sequence
  PIP-72 polypeptide
MAISVTNNASNPVEVAINHWGTDGDTSFFSVANGKQETWDRSDLRGFVLSVKKNGAQHPYYVLSTSNIVIYDDKVTDSGQTLLPLS

SEQ ID NO: 601 - protein, 86 aa, Artificial Sequence
  PIP-72 polypeptide
MAISVTNNSSNPIEVAINHWGTDGDTSFFSVANGKQDSWDRSDLRGFVMSVQKNGAQHPYYVLSTSNIVIYDDKVTDSGQTIEPLS

SEQ ID NO: 602 - protein, 86 aa, Artificial Sequence
  PIP-72 polypeptide
MAISVTNNASNPVEVAINHWGTDGDTSFFSVANGKQDTWDRSDLRGFVMSVKKNGAQHPYYVLSTSNIVIYDDKVTDSGQLLLPLS

SEQ ID NO: 603 - protein, 86 aa, Artificial Sequence
  PIP-72 polypeptide
MAISVTNNASNPVEVAINHWGTDGDTSFFSVANGKQETWDRSDLRGFVMSVQKNGAQHPYYVLSTSNIVIYDDKVTDSGQTILPLN

SEQ ID NO: 604 - protein, 86 aa, Artificial Sequence
  PIP-72 polypeptide
MAISVTNNASNPVEVAINHWGTDGDTSFFSVANGKQDSWDRSDLRGFVMSVKKNGAQHPYYVLSTSNIVIYDDKVTDSGQLLEPLS

SEQ ID NO: 605 - protein, 86 aa, Artificial Sequence
  PIP-72 polypeptide
MAISVTNNASNPVEVSINHWGTDGDTSFFSVANGKQDSWDRSDLRGFVMSVQKNGAQHPYYVLSTSNIVIYDDKVTDSGQLLEPLS

SEQ ID NO: 606 - protein, 86 aa, Artificial Sequence
  PIP-72 polypeptide
MAISVTNSSSNPVEVSINHWGTDGDTSFFSVANGKQDSWDRSDLRGFVMSVQKNGAQHPYYVLSTSNIVIYDDKVTDSGQTLLPAS

SEQ ID NO: 607 - protein, 86 aa, Artificial Sequence
  PIP-72 polypeptide
MAISVTNNASNPVEVAINHWGTDGDTSFFSVANGKQDSWDRSDLRGFVLSVQKNGAQHPYYVLSTSNIVIYDDKVTDSGQTLLPLS

SEQ ID NO: 608 - protein, 86 aa, Artificial Sequence
  PIP-72 polypeptide
MGITVTNNSSGPIEVAINHWGSDGDTQFFPVGSGKQESWDRSDDRGFVLSLKNNGAQHPYYVQASSKIEVENNYVKDSGELILPLS

SEQ ID NO: 609 - protein, 86 aa, Artificial Sequence
  PIP-72 polypeptide
MGITVTNNSSGDIEVAINHWGSDGDTQFFKVAPGKQESWDRSDARGFVLSLKNNGAQHPYYVQASSKIEVENNAVKDQGQLILPLS

SEQ ID NO: 610 - protein, 86 aa, Artificial Sequence
  PIP-72 polypeptide
MGITVTNNSSGDIEVAINHWGSDGDTSFFKVAPGKQETWDRSDDRGFVLSLKNNGAQHPYYVQASSKIEVENDYVKDQGQLILPLS

SEQ ID NO: 611 - protein, 86 aa, Artificial Sequence
  PIP-72 polypeptide
MGITVTNNLSNDIEVAINHWGSDGDTQFFKVGPGKQESWDRSDARGFVLSLKKNGAQHPYYVQASSKIEVENDAVKDSGELILPLS

SEQ ID NO: 612 - protein, 86 aa, Artificial Sequence
  PIP-72 polypeptide
MGITVTNSSSGDIEVAINHWGSDGDTSFFKVGSGKQESWDRSDDRGFVLSLKNNGAQHPYYVQASSKIEVENNYVKDSGELIEPLS

SEQ ID NO: 613 - protein, 86 aa, Artificial Sequence
  PIP-72 polypeptide
MGITVTNNSSGPIEVAINHWGSDGDTQFFKVAPGKQESWDRSDDRGFVLSLKNNGAQHPYYVQASSKIEVENDAVKDSGELIEPLS

SEQ ID NO: 614 - protein, 86 aa, Artificial Sequence
  PIP-72 polypeptide
MGITVTNSSSGDIEVAINHWGSDGDTQFFKVGSGKQETWDRSDDRGFVLSLKNNGAQHPYYVQASSKIEVENDAVKDSGQLIEPLS

SEQ ID NO: 615 - protein, 86 aa, Artificial Sequence
  PIP-72 polypeptide
MGITVTNNSSKPIEAAINHWGSDGDTSFFSVGNGKQETWDRSDSRGFVLSLKRNGAQAPYYVQASSKIEVDNNAVKDQGRLIEPLS

SEQ ID NO: 616 - protein, 86 aa, Artificial Sequence
  PIP-72 polypeptide
MGITVTNNSSNPIEVAINHWGSDGDTSFFSVGNGKQESWDRSDSRGFVLSLKRNGAQHPYYVQASSKIEVDNNAVKDQGRLIEPLS

SEQ ID NO: 617 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNAVKDQGQLIQPLS

SEQ ID NO: 618 - protein, 86 aa, Artificial Sequence
  PIP-72 polypeptide
MGITVTNNSSKPIEVAINHWGSDGDTSFFSVGNGKQESWDRSDSRGFVLSLKKNGAQHPYYVQASSKIEVDNNAVKDQGRLIEPLS

SEQ ID NO: 619 - protein, 86 aa, Artificial Sequence
  PIP-72 polypeptide
MGITVTNNSSNPIEAAINKWGSDGDTSFFSVGNGKQETWDRSDSRGFVLSLKRNGAQAPYYVQASSKIEVDNNAVKDQGRLIEPLS

SEQ ID NO: 620 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNTVKDQGRLIEPLS

SEQ ID NO: 621 - protein, 86 aa, Artificial Sequence
  PIP-72 polypeptide
MGITVTNNSSNPIEVAINHWGSDGDTSFFSVGNGKQETWDRSDSRGFVLSLKRNGAQHPYYVQASSKIEVDNNAVKDQGRLIHPVS

SEQ ID NO: 622 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQASSKIEVDNNAVKDQGRLIHPVS

SEQ ID NO: 623 - protein, 86 aa, Artificial Sequence
  PIP-72 polypeptide
MGITVTNNSSKPIEAAINHWGSDGDTSFFSVGNGKQETWDRSDSRGFVLSLKRNGAQHPYYVQASSKIEVDNNAVKDQGRLIEPLS

SEQ ID NO: 624 - protein, 86 aa, Artificial Sequence
  PIP-72 polypeptide
MGITVTNNSSNPIEVAINHWGSDGDTSFFSVGSGKQETWDRSDSRGFVLSLKRNGAQHPYYVQASSKIEVDNNTVKDQGELIEPLS

SEQ ID NO: 625 - protein, 86 aa, Artificial Sequence
  PIP-72 polypeptide
MGITVTNNSSNPIEVAINHWGSDGDTSFFSVGNGKQESWDRSDSRGFVLSLKRNGAQAPYYVQASSKIEVDNNAVKDQGRLIEPVS

SEQ ID NO: 626 - protein, 86 aa, Artificial Sequence
  PIP-72 polypeptide
MGITVTNNSSNPIEVAINHWGSDGDTSFFSVGNGKQETWDRSDSRGFVLSLKRNGAQHPYYVQASSKIEVDNNAVKDQGRLIHPLS

SEQ ID NO: 627 - protein, 86 aa, Artificial Sequence
  PIP-72 polypeptide
MGITVTNNSSKKIEVAINKWGSDGDTSFFSVGNGKQETWDRSDSRGFVLSLKKNGAQAPYYVQASSKIEVDNNAVKDQGRLIEPLS

SEQ ID NO: 628 - protein, 86 aa, Artificial Sequence
  PIP-72 polypeptide
MGITVTNNSSKPIEVAINHWGSDGDTSFFGVDNGKQESWDRSDSRGFVLSLKRNGAQHPYYVQATSKIEVENNTVKDQGRLIEPVA

SEQ ID NO: 629 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQATSKIEIDNNAVKDQGRLIEPLS

SEQ ID NO: 630 - protein, 86 aa, Artificial Sequence
  PIP-72 polypeptide
MGITVTNNSSNPIEAAINKWGSDGDTSFFSIDSGKQESWDRSDSRGFVLSLKRNGAQHPYYVQASSKIEVDNNAVKDQGRLIEPLS

SEQ ID NO: 631 - protein, 86 aa, Artificial Sequence; identical to SEQ ID NO: 616
  PIP-72 polypeptide

SEQ ID NO: 632 - protein, 86 aa, Artificial Sequence
  PIP-72 polypeptide
MGITVTNNSSNPIEVAINHWGSDGDTSFFSVGNGKQETWDRSDSRGFVLSLKNNGAQHPYYVQASSKIEVDNNAVKDQGRLIEPLS

SEQ ID NO: 633 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGRLIHPLS

SEQ ID NO: 634 - protein, 86 aa, Artificial Sequence
  PIP-72 polypeptide
MGITVTNNSSNKIEVAINKWGSDGDTSFFSVGNGKQETWDRSDSRGFVLSLKKNGAQHPYYVQASSKIEVDNNAVKDQGRLIEPLS

SEQ ID NO: 635 - protein, 86 aa, Artificial Sequence
  PIP-72 polypeptide
MGITVTNNSSNPIEVAINHWGSDGDTSFFGVGSGKQESWDRSDSRGFVLSLKKNGAQHPYYVQASSKIEVDNNAVKDQGRLIEPLS

SEQ ID NO: 636 - protein, 86 aa, Artificial Sequence
  PIP-72 polypeptide
MGITVTNNSSNPIEVAINHWGSDGDTSFFSVGNGKQETWDRSDSRGFVLSLKKNGAQAPYYVQASSKIEVDNNAVKDQGELIEPVS

SEQ ID NO: 637 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGRLIHPVA

SEQ ID NO: 638 - protein, 86 aa, Artificial Sequence
  PIP-72 polypeptide
MGITVTNNSSKPIEAAINHWGSDGDTSFFSVGNGKQETWDRSDSRGFVLSLKKNGAQHPYYVQASSKIEVDNNAVKDQGRLIHPLS

SEQ ID NO: 639 - protein, 86 aa, Artificial Sequence
  PIP-72 polypeptide
MGITVTNNSSKPIEVAINKWGSDGDTSFFSVGNGKQETWDRSDSRGFVLSLKKNGAQHPYYVQASSKIEVDNNAVKDQGRLIEPLS

SEQ ID NO: 640 - protein, 86 aa, Artificial Sequence
  PIP-72 polypeptide
MGITVTNNSSNPIEVAINHWGSDGDTSFFGIGSGKQESWDRSDSRGFVLSLKKNGAQHPYYVQASSKIEVDNNAVKDQGRLIEPLS

SEQ ID NO: 641 - protein, 86 aa, Artificial Sequence
  PIP-72 polypeptide
MGITVTNNSSKKIEAAINKWGSDGDTSFFSVGNGKQETWDRSDSRGFVLSLKKNGAQHPYYVQATSKIEIENNTVKDQGRLIEPLS

SEQ ID NO: 642 - protein, 86 aa, Artificial Sequence
  PIP-72 polypeptide
MGITVTNNSSNPIEVAINKWGSDGDTSFFSVGNGKQETWDRSDSRGFVLSLKRNGAQAPYYVQATSKIEIENNTVKDQGRLIEPLS

SEQ ID NO: 643 - protein, 86 aa, Artificial Sequence
  PIP-72 polypeptide
MGITVTNNSSNPIEVAINHWGSDGDTSFFGIDSGKQESWDRSDSRGFVLSLKKNGAQHPYYVQASSKIEVDNNAVKDQGRLIEPLS

SEQ ID NO: 644 - protein, 86 aa, Artificial Sequence
  PIP-72 polypeptide
MGITVTNNSSKKIEAAINKWGSDGDTSFFSVGNGKQETWDRSDSRGFVLSLKKNGAQHPYYVQASSKIEVDNNAVKDQGRLIEPLS

SEQ ID NO: 645 - protein, 86 aa, Artificial Sequence
  PIP-72 polypeptide
MGITVTNNSSKKIEAAINKWGSDGDTSFFGIDSGKQESWDRSDSRGFVLSLKKNGAQHPYYVQASSKIEVDNNAVKDQGRLIEPLS

SEQ ID NO: 646 - protein, 86 aa, Artificial Sequence
  PIP-72 polypeptide
MGITVTNNSSKKIEAAINKWGSDGDTSFFSVGNGKQETWDRSDSRGFVLSLKSNGAQHPYYVQASSKIEVDNNAVKDQGRLIEPLS

SEQ ID NO: 647 - protein, 86 aa, Artificial Sequence
  PIP-72 polypeptide
MGITVTNNSSKKIEAAINKWGSDGDTSFFSVGNGKQESWDRSDSRGFVLSLKRNGAQAPYYVQATSKIEIENNTVKDQGRLIEPLS

SEQ ID NO: 648 - protein, 86 aa, Artificial Sequence
  PIP-72 polypeptide
MGITVTNNSSKKIEAAINKWGSDGDTSFFGIDSGKQESWDRSDSRGFVLSLKKNGAQHPYYVQATSKIEIENNTVKDQGRLIEPLS

SEQ ID NO: 649 - protein, 86 aa, Artificial Sequence
  PIP-72 polypeptide
MGITVTNNSSNPIEVAINHWGSDGDTSFFGIDSGKQESWDRSDSRGFVLSLKRNGAQAPYYVQASSKIEVDNNAVKDQGRLIEPLS

SEQ ID NO: 650 - protein, 86 aa, Artificial Sequence
  PIP-72 polypeptide
MGITVTNNSSNPIEVAINHWGSDGDTSFFSVGNGKQESWDRSDSRGFVLSLKKNGAQHPYYVQASSKIEVDNNAVKDQGRLIEPLS

SEQ ID NO: 651 - protein, 86 aa, Artificial Sequence
  PIP-72 polypeptide
MGITVTNNSSNPIEAAINKWGSDGDTSFFSVGNGKQETWDRSDSRGFVLSLKKNGAQHPYYVQASSKIEVDNNAVKDQGRLIEPLS

SEQ ID NO: 652 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQASSKIEVDNNAVKDQGRLIEPLS

SEQ ID NO: 653 - protein, 86 aa, Artificial Sequence
  PIP-72 polypeptide
MGITVTNNSSNPIEVAINHWGSDGDTSFFSVGNGKQESWDRSDSRGFVLSLKKNGAQAPYYVQASSKIEVDNNAVKDQGRLIEPLS

SEQ ID NO: 654 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQASSKIEVDNNTVKDQGRLIEPLS

SEQ ID NO: 655 - protein, 86 aa, Artificial Sequence
  PIP-72 polypeptide
MGITVTNNSSNPIEVAINHWGSDGDTSFFSVGNGKQETWDRSDSRGFVLSLKRNGAQHPYYVQASSKIEVDNNAVKDQGRLIEPLS

SEQ ID NO: 656 - protein, 86 aa, Artificial Sequence
  PIP-72 polypeptide
MGITVTNNSSKKIEAAINKWGSDGDTSFFGIDSGKQESWDRSDSRGFVLSLKRNGAQAPYYVQASSKIEVDNNAVKDQGRLIEPLS

SEQ ID NO: 657 - protein, 86 aa, Artificial Sequence
  PIP-72 polypeptide
MGITVTNNSSNPIEVAINHWGSDGDTSFFSVGNGKQETWDRSDSRGFVLSLKKNGAQAPYYVQASSKIEVDNNAVKDQGRLIEPLS

SEQ ID NO: 658 - protein, 86 aa, Artificial Sequence
  PIP-72 polypeptide
MGITVTNNSSNPIEVAINHWGSDGDTSFFGIDSGKQESWDRSDSRGFVLSLKKNGAQHPYYVQATSKIEIENNTVKDQGRLIEPLS

SEQ ID NO: 659 - protein, 86 aa, Artificial Sequence
  PIP-72 polypeptide
MGITVTNNSSKKIEAAINKWGSDGDTSFFSVGNGKQESWDRSDSRGFVLSLKKNGAQAPYYVQASSKIEVDNNAVKDQGRLIEPLS

SEQ ID NO: 660 - protein, 86 aa, Artificial Sequence
  PIP-72 polypeptide
MGITVTNNSSKKIEAAINKWGSDGDTSFFGIDSGKQETWDRSDSRGFVLSLKRNGAQAPYYVQASSKIEVDNNAVKDQGRLIEPLS

SEQ ID NO: 661 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQATSKIEIENNTVKDQGRLIEPLS

SEQ ID NO: 662 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQATSKIEIENNTVKDQGRLIEPLS

SEQ ID NO: 663 - protein, 86 aa, Artificial Sequence
  PIP-72 polypeptide
MGITVTNNSSKKIEAAINKWGSDGDTSFFSVGSGKQESWDRSDSRGFVLSLKKNGAQHPYYVQASSKIEVDNNAVKDQGRLIEPLS

SEQ ID NO: 664 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQASSKIEIENNTVKDQGRLIEPLS

SEQ ID NO: 665 - protein, 86 aa, Artificial Sequence
  PIP-72 polypeptide
MGITVTNNSSNPIEVAINHWGSDGDTSFFGIDSGKQESWDRSDSRGFVLSLKRNGAQAPYYVQASSKIEVDNNTVKDQGRLIEPLS

SEQ ID NO: 666 - protein, 86 aa, Artificial Sequence
  PIP-72 polypeptide
MGITVTNNSSKKIEAAINKWGSDGDTSFFSVGNGKQETWDRSDSRGFVLSLKRNGAQAPYYVQASSKIEVDNNAVKDQGRLIEPLS

SEQ ID NO: 667 - protein, 86 aa, Artificial Sequence
  PIP-72 polypeptide
MGITVTNNSSNPIEVAINHWGSDGDTSFFSVGNGKQETWDRSDSRGFVLSLKSNGAQAPYYVQASSKIEVDNNAVKDQGRLIEPLS

SEQ ID NO: 668 - protein, 86 aa, Artificial Sequence
  PIP-72 polypeptide
MGITVTNNSSKKIEAAINKWGSDGDTSFFGIDSGKQESWDRSDSRGFVLSLKRNGAQAPYYVQASSKIEVDNNAVKDQGELIHPVA

SEQ ID NO: 669 - protein, 86 aa, Artificial Sequence
  PIP-72 polypeptide
MGITVTNNSSKKIEAAINKWGSDGDTSFFGIDSGKQESWDRSDSRGFVLSLKRNGAQAPYYVQATSKIEIENNTVKDQGRLIEPLS

SEQ ID NO: 670 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGELIEPLA

SEQ ID NO: 671 - protein, 86 aa, Artificial Sequence
  PIP-72 polypeptide
MGITVTNNSSKPIEAAINHWGSDGDTSFFSVGNGKQETWDRSDSRGFVLSLKKNGAQHPYYVQASSKIEVDNNAVKDQGRLIEPVS

SEQ ID NO: 672 - protein, 86 aa, Artificial Sequence
  PIP-72 polypeptide
MGITVTNNSSNPIEVAINKWGSDGDTSFFSVGNGKQETWDRSDSRGFVLSLKKNGAQHPYYVQASSKIEVDNNAVKDQGRLIEPLS

SEQ ID NO: 673 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNAVKDQGRLIHPVS

SEQ ID NO: 674 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNAVKDQGRLIEPLS

SEQ ID NO: 675 - protein, 86 aa, Artificial Sequence
  PIP-72 polypeptide
MGITVTNNSSKPIEAAINHWGSDGDTSFFSVGNGKQETWDRSDSRGFVLSLKKNGAQHPYYVQASSKIEVDNNAVKDQGRLIHPVA

SEQ ID NO: 676 - protein, 86 aa, Artificial Sequence
  PIP-72 polypeptide
MGITVTNNSSKPIEVAINHWGSDGDTSFFSVGNGKQETWDRSDSRGFVLSLKKNGAQAPYYVQASSKIEVDNNAVKDQGELIEPVA

SEQ ID NO: 677 - protein, 86 aa, Artificial Sequence
  PIP-72 polypeptide
MGITVTNNSSKKIEAAINHWGSDGDTSFFSVGNGKQETWDRSDSRGFVLSLKKNGAQHPYYVQASSKIEVDNNAVKDQGRLIEPLS

SEQ ID NO: 678 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNAVKDQGELIEPLA

SEQ ID NO: 679 - protein, 86 aa, Artificial Sequence
  PIP-72 polypeptide
MGITVTNNSSKPIEAAINHWGSDGDTSFFSVGNGKQETWDRSDSRGFVLSLKKNGAQHPYYVQASSKIEVDNNAVKDQGRLIEPLS

SEQ ID NO: 680 - protein, 86 aa, Artificial Sequence
  PIP-72 polypeptide
MGITVTNNSSKPIEAAINKWGSDGDTSFFSVGNGKQETWDRSDSRGFVLSLKKNGAQHPYYVQASSKIEVDNNAVKDQGRLIEPLS

SEQ ID NO: 681 - protein, 86 aa, Artificial Sequence
  PIP-72 polypeptide
MGITVTNNSSNKIEVAINHWGSDGDTSFFSVGNGKQETWDRSDSRGFVLSLKKNGAQHPYYVQASSKIEVDNNAVKDQGRLIEPLS

SEQ ID NO: 682 - protein, 86 aa, Artificial Sequence
  PIP-72 polypeptide
MGITVTNNSSNKIEAAINKWGSDGDTSFFSVGNGKQETWDRSDSRGFVLSLKKNGAQHPYYVQASSKIEVDNNAVKDQGRLIEPLS

SEQ ID NO: 683 - protein, 86 aa, Artificial Sequence
  PIP-72 polypeptide
MGITVTNNSSNKIEAAINHWGSDGDTSFFSVGNGKQETWDRSDSRGFVLSLKKNGAQHPYYVQASSKIEVDNNAVKDQGRLIEPLS

SEQ ID NO: 684 - protein, 86 aa, Artificial Sequence
  PIP-72 polypeptide
MGITVTNNSSNPIEAAINHWGSDGDTSFFSVGNGKQETWDRSDSRGFVLSLKKNGAQHPYYVQASSKIEVDNNAVKDQGRLIEPLS

SEQ ID NO: 685 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGELIEPLS

SEQ ID NO: 686 - protein, 86 aa, Artificial Sequence
  PIP-72 polypeptide
MGITVTNNSSNPIEVAINKWGSDGDTSFFSVGNGKQETWDRSDSRGFVLSLKRNGAQHPYYVQASSKIEVDNNAVKDQGRLIEPLS

SEQ ID NO: 687 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGRLIHPVS

SEQ ID NO: 688 - protein, 86 aa, Artificial Sequence
  PIP-72 polypeptide
MGITVTNNSSNPIEVAINHWGSDGDTSFFSVGSGKQESWDRSDSRGFVLSLKKNGAQHPYYVQASSKIEVDNNAVKDQGRLIEPLS

SEQ ID NO: 689 - protein, 86 aa, Artificial Sequence
  PIP-72 polypeptide
MGITVTNNSSNPIEVAINHWGSDGDTSFFGIDSGKQESWDRSDSRGFVLSLKRNGAQHPYYVQASSKIEVDNNAVKDQGRLIEPLS

SEQ ID NO: 690 - protein, 86 aa, Artificial Sequence
  PIP-72 polypeptide
MGITVTNNSSNPIEVAINHWGSDGDTSFFSIDNGKQESWDRSDSRGFVLSLKKNGAQHPYYVQASSKIEVDNNAVKDQGELIEPVS

SEQ ID NO: 691 - protein, 86 aa, Artificial Sequence
  PIP-72 polypeptide
MGITVTNNSSNPIEVAINHWGSDGDTSFFSVGNGKQETWDRSDSRGFVLSLKRNGAQHPYYVQASSKIEVDNNAVKDQGELIEPLA

SEQ ID NO: 692 - protein, 86 aa, Artificial Sequence
  PIP-72 polypeptide
MGITVTNNSSNPIEVAINHWGSDGDTSFFGVGSGKQETWDRSDSRGFVLSLKKNGAQHPYYVQASSKIEVDNNAVKDQGELIEPLA

SEQ ID NO: 693 - protein, 86 aa, Artificial Sequence
  PIP-72 polypeptide
MGITVTNNSSNPIEVAINHWGSDGDTSFFSVDNGKQETWDRSDSRGFVLSLKRNGAQHPYYVQASSKIEVDNNAVKDQGELIHPLS

SEQ ID NO: 694 - protein, 86 aa, Artificial Sequence
  PIP-72 polypeptide
MGITVTNNSSNPIEVAINHWGSDGDTSFFGIDSGKQETWDRSDSRGFVLSLKKNGAQHPYYVQASSKIEVDNNAVKDQGRLIEPLS

SEQ ID NO: 695 - protein, 86 aa, Artificial Sequence
  PIP-72 polypeptide
MGITVTNNSSNPIEVAINHWGSDGDTSFFGVGNGKQETWDRSDSRGFVLSLKRNGAQHPYYVQASSKIEVDNNAVKDQGRLIEPLS

SEQ ID NO: 696 - protein, 86 aa, Artificial Sequence
  PIP-72 polypeptide
MGITVTNNSSNPIEVAINHWGSDGDTSFFSVGSGKQETWDRSDSRGFVLSLKRNGAQHPYYVQASSKIEVDNNAVKDQGELIEPLA

SEQ ID NO: 697 - protein, 86 aa, Artificial Sequence
  PIP-72 polypeptide
MGITVTNNSSNPIEVAINHWGSDGDTSFFGVGNGKQETWDRSDSRGFVLSLKKNGAQHPYYVQASSKIEVDNNAVKDQGRLIEPLS

SEQ ID NO: 698 - protein, 86 aa, Artificial Sequence
  PIP-72 polypeptide
MGITVTNNSSNPIEVAINHWGSDGDTSFFGIDSGKQETWDRSDSRGFVLSLKRNGAQHPYYVQASSKIEVDNNAVKDQGRLIEPLS

SEQ ID NO: 699 - protein, 86 aa, Artificial Sequence
  PIP-72 polypeptide
MGITVTNNSSNPIEVAINHWGSDGDTSFFSVGNGKQETWDRSDSRGFVLSLKHNGAQPPYYVQASSKIEVDNNAVKDQGRLIHPLA

SEQ ID NO: 700 - protein, 86 aa, Artificial Sequence
  PIP-72 polypeptide
MGITVTNNSSNPIEVAINHWGSDGDTSFFSVDSGKQESWDRSDSRGFVLSLKKNGAQHPYYVQASSKIEVDNNAVKDQGRLIEPVA

SEQ ID NO: 701 - protein, 86 aa, Artificial Sequence
  PIP-72 polypeptide
MGITVTNNSSNPIEVAINHWGSDGDTSFFSVGSGKQETWDRSDSRGFVLSLKKNGAQHPYYVQASSKIEVDNNAVKDQGRLIEPLS

SEQ ID NO: 702 - protein, 86 aa, Artificial Sequence
  PIP-72 polypeptide
MGITVTNNSSNPIEVAINHWGSDGDTSFFSVGSGKQESWDRSDSRGFVLSLKRNGAQAPYYVQASSKIEVDNNAVKDQGELIEPLS

SEQ ID NO: 703 - protein, 86 aa, Artificial Sequence
  PIP-72 polypeptide
MGITVTNNSSNPIEVAINHWGSDGDTSFFGIGSGKQESWDRSDSRGFVLSLKRNGAQAPYYVQASSKIEVDNNAVKDQGELIEPVS

SEQ ID NO: 704 - protein, 86 aa, Artificial Sequence
  PIP-72 polypeptide
MGITVTNNSSNPIEVAINHWGSDGDTSFFSVDNGKQETWDRSDSRGFVLSLKKNGAQHPYYVQASSKIEVDNNAVKDQGRLIEPLS

SEQ ID NO: 705 - protein, 86 aa, Artificial Sequence
  PIP-72 polypeptide
MGITVTNNSSNPIEVAINHWGSDGDTSFFGVDSGKQETWDRSDSRGFVLSLKKNGAQHPYYVQASSKIEVDNNAVKDQGRLIEPVA

SEQ ID NO: 706 - protein, 86 aa, Artificial Sequence
  PIP-72 polypeptide
MGITVTNNSSNPIEVAINHWGSDGDTSFFGIGNGKQESWDRSDSRGFVLSLKKNGAQHPYYVQASSKIEVDNNAVKDQGRLIEPLS

SEQ ID NO: 707 - protein, 86 aa, Artificial Sequence
  PIP-72 polypeptide
MGITVTNNSSNPIEVAINHWGSDGDTSFFGVDSGKQESWDRSDSRGFVLSLKKNGAQAPYYVQASSKIEVDNNAVKDQGRLIEPLS

SEQ ID NO: 708 - protein, 86 aa, Artificial Sequence
  PIP-72 polypeptide
MGITVTNNSSNPIEVAINHWGSDGDTSFFGVGSGKQETWDRSDSRGFVLSLKKNGAQAPYYVQASSKIEVDNNAVKDQGRLIEPLS

SEQ ID NO: 709 - protein, 86 aa, Artificial Sequence
  PIP-72 polypeptide
MGITVTNKSSKKIEASINKWGSDGDTKFFGIDSGKQESWDRSDDRGFVLSLKRNGAQAPYYVQATSKIEIENSTVKDHGETIHPVA

SEQ ID NO: 710 - protein, 86 aa, Artificial Sequence
  PIP-72 polypeptide
MGITVTNKSSKKIEASINKWGSDGDTKFFGIDSGKQESWDRSDDRGFVLSLKKNGTQAPYYVQATSKIEIENSTVKDHGETIHPVA

SEQ ID NO: 711 - protein, 86 aa, Artificial Sequence
  PIP-72 polypeptide
MGITVTNKSSKKIEASINKWGSDGDTKFFGIDSGKQESWDRSDDRGFVLSLKKNGAQAPYYVQATSKIEIENSTVKDHGETIHPVA

SEQ ID NO: 712 - protein, 86 aa, Artificial Sequence
  PIP-72 polypeptide
MGITVTNKSSKKIEASINKWGSDGDTKFFGIDSGKQESWDRSDDRGFVLSLKKNGAQAPYYVQATSKIEIENSTVKDQGRLIHPVS

SEQ ID NO: 713 - protein, 86 aa, Artificial Sequence
  PIP-72 polypeptide
MGITVTNNSSKPIEAAINHWGSDGDTKFFGIDSGKQESWDRSDDRGFVLSLKKNGAQHPYYVQATSKIEIENSTVKDHGETIHPVA

SEQ ID NO: 714 - protein, 86 aa, Artificial Sequence
  PIP-72 polypeptide
MGITVTNNSSKPIEAAINKWGSDGDTKFFGIDSGKQESWDRSDDRGFVLSLKRNGAQAPYYVQATSKIEIENSTVKDHGETIHPVA

SEQ ID NO: 715 - protein, 86 aa, Artificial Sequence
  PIP-72 polypeptide
MGITVTNNSSKPIEAAINKWGSDGDTKFFGIDSGKQESWDRSDDRGFVLSLKRNGAQAPYYVQATSKIEIENSTVKDQGELIHPVS

SEQ ID NO: 716 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENSTVKDHGELIEPVA

SEQ ID NO: 717 - protein, 86 aa, Artificial Sequence
  PIP-72 polypeptide
MGITVTNKSSKKIEASINKWGSDGDTKFFGIDSGKQESWDRSDDRGFVLSLKKNGAQHPYYVQATSKIEIENSTVKDHGETIHPVA

SEQ ID NO: 718 - protein, 86 aa, Artificial Sequence
  PIP-72 polypeptide
MGITVTNKSSKKIEASINKWGSDGDTKFFGIDSGKQESWDRSDDRGFVLSLKRNGTQAPYYVQATSKIEIENSTVKDQGELIEPLA

SEQ ID NO: 719 - protein, 86 aa, Artificial Sequence
  PIP-72 polypeptide
MGITVTNNSSNKIEAAINKWGSDGDTKFFGIDSGKQESWDRSDDRGFVLSLKRNGTQAPYYVQATSKIEIENSTVKDHGETIHPVA

SEQ ID NO: 720 - protein, 86 aa, Artificial Sequence
  PIP-72 polypeptide
MGITVTNKSSKKIEASINKWGSDGDTKFFGIDSGKQESWDRSDDRGFVLSLKRNGAQAPYYVQATSKIEIENSTVKDQGELIHPVA

SEQ ID NO: 721 - protein, 86 aa, Artificial Sequence
  PIP-72 polypeptide
MGITVTNKSSKKIEASINKWGRDGDTKFFGIDSGKQESWDRSDDRGFVLSLKRNGTQAPYYVQATSKIEIENSTVKDQGRLIHPVA

SEQ ID NO: 722 - protein, 86 aa, Artificial Sequence
  PIP-72 polypeptide
MGITVTNKSSKKIEASINKWGSDGDTSFFSIGSGKQETWDRSDDRGFVLSLKRNGAQHPYYVQATSKIEIENSTVKDHGETIHPVA

SEQ ID NO: 723 - protein, 86 aa, Artificial Sequence
  PIP-72 polypeptide
MGITVTNKSSKKIEASINKWGSDGDTSFFGVGSGKQETWDRSDDRGFVLSLKRNGTQAPYYVQATSKIEIENSTVKDHGETIHPVA

SEQ ID NO: 724 - protein, 86 aa, Artificial Sequence
  PIP-72 polypeptide
MGITVTNKSSKKIEASINKWGSDGDTSFFGVDSGKQETWDRSDDRGFVLSLKRNGTQAPYYVQATSKIEIENSTVKDHGETIHPVA

SEQ ID NO: 725 - protein, 86 aa, Artificial Sequence
  PIP-72 polypeptide
MGITVTNKSSKKIEASINKWGSDGDTSFFGVDSGKQESWDRSDDRGFVLSLKRNGTQAPYYVQATSKIEIENSTVKDHGETIHPVA

SEQ ID NO: 726 - protein, 86 aa, Artificial Sequence
  PIP-72 polypeptide
MGITVTNKSSKKIEASINKWGSDGDTKFFGIDSGKQESWDRSDSRGFVLSLKRNGTQAPYYVQATSKIEIENSTVKDHGETIHPVA

SEQ ID NO: 727 - protein, 86 aa, Artificial Sequence
  PIP-72 polypeptide
MGITVTNKSSKKIEASINKWGSDGDTSFFGVGSGKQESWDRSDDRGFVLSLKRNGTQAPYYVQATSKIEIENSTVKDHGETIHPVA

SEQ ID NO: 728 - protein, 86 aa, Artificial Sequence
  PIP-72 polypeptide
MGITVTNKSSKKIEASINKWGSDGDTSFFSIDSGKQETWDRSDDRGFVLSLKRNGAQHPYYVQATNKIEIENSTVKDHGETIHPVA

SEQ ID NO: 729 - protein, 86 aa, Artificial Sequence
  PIP-72 polypeptide
MGITVTNKSSKKIEASINKWGSDGDTKFFGIDSGKQETWDRSDDRGFVLSLKRNGTQAPYYVQATSKIEIENSTVKDHGETIHPVA

SEQ ID NO: 730 - protein, 86 aa, Artificial Sequence
  PIP-72 polypeptide
MGITVTNKSSKKIEASINKWGSDGDTKFFGIDSGKQETWDRSDSRGFVLSLKRNGAQAPYYVQATSKIEIENSTVKDHGETIHPVA

SEQ ID NO: 731 - protein, 86 aa, Artificial Sequence
  PIP-72 polypeptide
MGITVTNKSSKKIEASINKWGSDGDTKFFGIDSGKQETWDRSDDRGFVLSLKRNGAQAPYYVQATSKIEIENSTVKDQGELIHPVS

SEQ ID NO: 732 - protein, 86 aa, Artificial Sequence
  PIP-72 polypeptide
MGITVTNKSSKKIEASINKWGSDGDTKFFGVGSGKQETWDRSDDRGFVLSLKRNGTQAPYYVQATSKIEIENSTVKDQGELIEPLS

SEQ ID NO: 733 - protein, 86 aa, Artificial Sequence
  PIP-72 polypeptide
MGITVTNKSSKKIEASINKWGSDGDTSFFGVDSGKQETWDRSDDRGFVLSLKRNGAQHPYYVQATSKIEIENSTVKDHGETIHPVA

SEQ ID NO: 734 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENSTVKDQGELIHPVA

SEQ ID NO: 735 - protein, 86 aa, Artificial Sequence
  PIP-72 polypeptide
MGITVTNKSSKKIEASINKWGSDGDTSFFSVGSGKQETWDRSDDRGFVLSLKRNGAQAPYYVQATSKIEIENSTVKDHGETIHPVA

SEQ ID NO: 736 - protein, 86 aa, Artificial Sequence
  PIP-72 polypeptide
MGITVTNNSSNPIEVAINKWGSDGDTKFFGIDSGKQESWDRSDDRGFVLSLKRNGAQHPYYVQATSKIEIENSTVKDHGETIHPVA

SEQ ID NO: 737 - protein, 86 aa, Artificial Sequence
  PIP-72 polypeptide
MGITVTNNSSNKIEAAINKWGSDGDTKFFGIDSGKQESWDRSDDRGFVLSLKRNGAQAPYYVQATSKIEIENSTVKDHGETIHPVA

SEQ ID NO: 738 - protein, 86 aa, Artificial Sequence
  PIP-72 polypeptide
MGITVTNNSSNPIEVAINKWGSDGDTKFFGIDSGKQESWDRSDDRGFVLSLKRNGTQAPYYVQASSKIEIENNAVKDQGETIHPVA

SEQ ID NO: 739 - protein, 86 aa, Artificial Sequence
  PIP-72 polypeptide
MGITVTNKSSKKIEASINKWGSDGDTKFFGIDSGKQESWDRSDDRGFVLSLKKNGAQAPYYVQATSKIEIENSTVKDQGELIHPLA

SEQ ID NO: 740 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENSTVKDHGETIHPVA

SEQ ID NO: 741 - protein, 86 aa, Artificial Sequence
  PIP-72 polypeptide
MGITVTNNSSKKIEAAINKWGSDGDTKFFGIDSGKQESWDRSDDRGFVLSLKKNGAQHPYYVQATSKIEIENSTVKDHGETIHPVA

SEQ ID NO: 742 - protein, 86 aa, Artificial Sequence
  PIP-72 polypeptide
MGITVTNNSSKPIEAAINHWGSDGDTKFFGIDSGKQESWDRSDDRGFVLSLKRNGAQAPYYVQATSKIEIENSTVKDHGETIHPVA

SEQ ID NO: 743 - protein, 86 aa, Artificial Sequence
  PIP-72 polypeptide
MGITVTNNSSKPIEAAINHWGSDGDTKFFGIDSGKQESWDRSDDRGFVLSLKRNGTQAPYYVQATSKIEIENSTVKDHGETIHPVA

SEQ ID NO: 744 - protein, 86 aa, Artificial Sequence
  PIP-72 polypeptide
MGITVTNKSSKKIEASINKWGSDGDTSFFGIDSGKQESWDRSDDRGFVLSLKKNGAQAPYYVQATSKIEIENSTVKDHGETIHPVA

SEQ ID NO: 745 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEVENNAVKDHGETIHPVA

SEQ ID NO: 746 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIDNNTVKDHGETIHPVA

SEQ ID NO: 747 - protein, 86 aa, Artificial Sequence
  PIP-72 polypeptide
MGITVTNNSSKKIEAAINHWGSDGDTKFFGIDSGKQESWDRSDDRGFVLSLKRNGTQAPYYVQATSKIEIENSTVKDHGETIHPVA

SEQ ID NO: 748 - protein, 86 aa, Artificial Sequence
  PIP-72 polypeptide
MGITVTNNSSKPIEAAINKWGSDGDTKFFGIDSGKQESWDRSDDRGFVLSLKRNGAQAPYYVQATSKIEIENSTVKDQGRLIHPLS

SEQ ID NO: 749 - protein, 86 aa, Artificial Sequence
  PIP-72 polypeptide
MGITVTNNSSKPIEAAINKWGSDGDTSFFSVDSGKQETWDRSDDRGFVLSLKRNGAQAPYYVQATSKIEIENSTVKDHGETIHPVA

SEQ ID NO: 750 - protein, 86 aa, Artificial Sequence
  PIP-72 polypeptide
MGITVTNKSSKKIEAAINKWGSDGDTSFFGVGSGKQETWDRSDDRGFVLSLKRNGTQAPYYVQATSKIEIENSTVKDHGETIHPVA

SEQ ID NO: 751 - protein, 86 aa, Artificial Sequence
  PIP-72 polypeptide
MGITVTNNSSNPIEVAINKWGSDGDTKFFGIGSGKQESWDRSDDRGFVLSLKRNGAQHPYYVQATSKIEIENSTVKDHGETIHPVA

SEQ ID NO: 752 - protein, 86 aa, Artificial Sequence
  PIP-72 polypeptide
MGITVTNKSSKKIEASINKWGSDGDTKFFGIDSGKQESWDRSDDRGFVLSLKSNGAQAPYYVQATSKIEIENSTVKDHGETIHPVA

SEQ ID NO: 753 - protein, 86 aa, Artificial Sequence
  PIP-72 polypeptide
MGITVTNKSSKKIEASINKWGSDGDTSFFGVGSGKQETWDRSDDRGFVLSLKKNGAQHPYYVQATSKIEIENSTVKDQGETIHPVA

SEQ ID NO: 754 - protein, 86 aa, Artificial Sequence
  PIP-72 polypeptide
MGITVTNKSSKKIEAAINKWGSDGDTKFFGIDSGKQESWDRSDDRGFVLSLKKNGAQHPYYVQASSKIEIENNTVKDHGETIHPVA

SEQ ID NO: 755 - protein, 86 aa, Artificial Sequence
  PIP-72 polypeptide
MGITVTNKSSKKIEASINHWGSDGDTSFFGIDSGKQESWDRSDDRGFVLSLKRNGAQHPYYVQATSKIEIENSTVKDHGETIHPVA

SEQ ID NO: 756 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENNAVKDQGRLIEPVA

SEQ ID NO: 757 - protein, 86 aa, Artificial Sequence
  PIP-72 polypeptide
MGITVTNNSSKPIEVAINHWGSDGDTKFFGIDSGKQESWDRSDDRGFVLSLKRNGTQAPYYVQATSKIEIENSTVKDHGETIHPVA

SEQ ID NO: 758 - protein, 86 aa, Artificial Sequence
  PIP-72 polypeptide
MGITVTNKSSKKIEAAINKWGSDGDTKFFGIDSGKQESWDRSDDRGFVLSLKKNGAQHPYYVQATSKIEIENSTVKDHGETIHPVA

SEQ ID NO: 759 - protein, 86 aa, Artificial Sequence; identical to SEQ ID NO: 714
  PIP-72 polypeptide

SEQ ID NO: 760 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENSTVKDQGELIHPVS

SEQ ID NO: 761 - protein, 86 aa, Artificial Sequence
  PIP-72 polypeptide
MGITVTNKSSKKIEASINKWGSDGDTKFFGIDSGKQETWDRSDDRGFVLSLKRNGAQHPYYVQATSKIEIENSTVKDHGETIHPVA

SEQ ID NO: 762 - protein, 86 aa, Artificial Sequence
  PIP-72 polypeptide
MGITVTNNSSKKIEVAINHWGSDGDTKFFGIDSGKQESWDRSDDRGFVLSLKRNGTQAPYYVQATSKIEIENSTVKDHGETIHPVA

SEQ ID NO: 763 - protein, 86 aa, Artificial Sequence; identical to SEQ ID NO: 717
  PIP-72 polypeptide

SEQ ID NO: 764 - protein, 86 aa, Artificial Sequence
  PIP-72 polypeptide
MGITVTNNSSKKIEVAINKWGSDGDTKFFGIDSGKQESWDRSDDRGFVLSLKRNGAQHPYYVQATSKIEIENSTVKDHGETIHPVA

SEQ ID NO: 765 - protein, 86 aa, Artificial Sequence
  PIP-72 polypeptide
MGITVTNKSSKKIEASINHWGSDGDTKFFGIDSGKQESWDRSDDRGFVLSLKKNGAQHPYYVQATSKIEIENSTVKDHGETIHPVA

SEQ ID NO: 766 - protein, 86 aa, Artificial Sequence
  PIP-72 polypeptide
MGITVTNNSSKKIEVAINKWGSDGDTKFFGIDSGKQESWDRSDDRGFVLSLKKNGAQHPYYVQATSKIEIENSTVKDHGETIHPVA

SEQ ID NO: 767 - protein, 86 aa, Artificial Sequence
  PIP-72 polypeptide
MGITVTNKSSKKIEASINKWGSDGDTKFFGIDSGKQETWDRSDDRGFVLSLKKNGAQAPYYVQATSKIEIENSTVKDHGETIHPVA

SEQ ID NO: 768 - protein, 86 aa, Artificial Sequence
  PIP-72 polypeptide
MGITVTNKSSKKIEVAINHWGSDGDTKFFGIDSGKQESWDRSDDRGFVLSLKRNGAQHPYYVQATSKIEIENSTVKDHGETIHPVA

SEQ ID NO: 769 - DNA, 261 bp, Artificial Sequence
  Coding sequence for PIP-72 polypeptide
atgggtattaccgttaccaacaaatcatcgaaaaaaattgaagcctcgatcaacaaatggggtagcgacggcgacaccaagttcttcggaatcgatagcggcaagcaggaaagctgggaccgatcagacgaccgtggctttgtgctgtcactgaagaagaatggcgcgcaacacccttactacgttcaggccagcagcaaaattgaagtcgacaacaacgccgtgaaagatcagggccggttgatcgagccgctctcgtaa

SEQ ID NO: 770 - DNA, 261 bp, Artificial Sequence
  Coding sequence for PIP-72 polypeptide
atgggtattaccgttaccaacaaatcatcgaaaaaaattgaagcctcgatcaacaaatggggtagcgacggcgacaccaagttcttcggaatcgatagcggcaagcaggaaagctgggaccgatcagacgaccgtggctttgtgctgtcactgaagaagaatggcgcgcaacacccttactacgttcaggccagcagcaaaattgaagtcgacaacaacgccgtgaaagaccacggcgaaaccatccacccggtcgcgtaa

SEQ ID NO: 771 - protein, 86 aa, Artificial Sequence
  PIP-72 polypeptide
MGITVTNKSSKKIEASINKWGSDGDTKFFGIDSGKQESWDRSDDRGFVLSLKKNGAQHPYYVQASSKIEVDNNAVKDQGRLIEPLS

SEQ ID NO: 772 - protein, 86 aa, Artificial Sequence
  PIP-72 polypeptide
MGITVTNKSSKKIEASINKWGSDGDTKFFGIDSGKQESWDRSDDRGFVLSLKKNGAQHPYYVQASSKIEVDNNAVKDHGETIHPVA

SEQ ID NO: 773 - DNA, 81 bp, Artificial Sequence
  mutagenesis primer
  misc_feature (29)..(29): s is g or c
  misc_feature (35)..(35): v is a, g or c
  misc_feature (52)..(52): r is a or g
  misc_feature (55)..(55): m is a or c
  misc_feature (61)..(61): m is a or c
gtcggtaacggcaagcagtgcggttgggscaggavcgacgcacgtggcttcrtcmtgtgtmtgaagaagaatggcgcgcaa

SEQ ID NO: 774 - DNA, 81 bp, Artificial Sequence
  mutagenesis primer
  misc_feature (29)..(29): s is g or c
  misc_feature (45)..(45): v is a, c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcggttgggscaggavcgacgcacgtggcttcrtcmtgdccmtgaagaagaatggcgcgcaa

SEQ ID NO: 775 - DNA, 81 bp, Artificial Sequence
  mutagenesis primer
  misc_feature (29)..(29): s is g or c
  misc_feature (35)..(35): v is a, c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcagtgcggttgggscaggavcgacarccgtggcttcrtcmtgtgtmtgaagaagaatggcgcgcaa

SEQ ID NO: 776 - DNA, 81 bp, Artificial Sequence
  mutagenesis primer
  misc_feature (29)..(29): s is g or c
  misc_feature (35)..(35): v is a, c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcggttgggscaggavcgacarccgtggcttcrtcmtgdccmtgaagaagaatggcgcgcaa

SEQ ID NO: 777 - DNA, 81 bp, Artificial Sequence
  mutagenesis primer
  misc_feature (30)..(30): w is a or t
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcagtgcggttgggawaggavcgacgcacgtggcttcrtcmtgtgtmtgaagaagaatggcgcgcaa

SEQ ID NO: 778 - DNA, 81 bp, Artificial Sequence
  mutagenesis primer
  misc_feature (30)..(30): w is a or t
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcggttgggawaggavcgacgcacgtggcttcrtcmtgdccmtgaagaagaatggcgcgcaa

SEQ ID NO: 779 - DNA, 81 bp, Artificial Sequence
  mutagenesis primer
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcagtgcggttgggawaggavcgacarccgtggcttcrtcmtgtgtmtgaagaagaatggcgcgcaa

SEQ ID NO: 780 - DNA, 81 bp, Artificial Sequence
  mutagenesis primer
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcggttgggawaggavcgacarccgtggcttcrtcmtgdccmtgaagaagaatggcgcgcaa

SEQ ID NO: 781 - DNA, 81 bp, Artificial Sequence
  mutagenesis primer
  misc_feature (22)..(22): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcagtgcwcttgggscaggavcgacgcacgtggcttcrtcmtgtgtmtgaagaagaatggcgcgcaa

SEQ ID NO: 782 - DNA, 81 bp, Artificial Sequence
  mutagenesis primer
  misc_feature (22)..(22): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcwcttgggscaggavcgacgcacgtggcttcrtcmtgdccmtgaagaagaatggcgcgcaa

SEQ ID NO: 783 - DNA, 81 bp, Artificial Sequence
  mutagenesis primer
  misc_feature (22)..(22): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcagtgcwcttgggscaggavcgacarccgtggcttcrtcmtgtgtmtgaagaagaatggcgcgcaa

SEQ ID NO: 784 - DNA, 81 bp, Artificial Sequence
  mutagenesis primer
  misc_feature (22)..(22): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcwcttgggscaggavcgacarccgtggcttcrtcmtgdccmtgaagaagaatggcgcgcaa

SEQ ID NO: 785 - DNA, 81 bp, Artificial Sequence
  mutagenesis primer
  misc_feature (22)..(22): w ir a or t
  misc_feature (30)..(30): w ir a or t
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcagtgcwcttgggawaggavcgacgcacgtggcttcrtcmtgtgtmtgaagaagaatggcgcgcaa

SEQ ID NO: 786 - DNA, 81 bp, Artificial Sequence
  mutagenesis primer
  misc_feature (22)..(22): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcwcttgggawaggavcgacgcacgtggcttcrtcmtgdccmtgaagaagaatggcgcgcaa

SEQ ID NO: 787 - DNA, 81 bp, Artificial Sequence
  mutagenesis primer
  misc_feature (22)..(22): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcagtgcwcttgggawaggavcgacarccgtggcttcrtcmtgtgtmtgaagaagaatggcgcgcaa

SEQ ID NO: 788 - DNA, 81 bp, Artificial Sequence
  mutagenesis primer
  misc_feature (22)..(22): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcwcttgggawaggavcgacarccgtggcttcrtcmtgdccmtgaagaagaatggcgcgcaa

SEQ ID NO: 789 - DNA, 81 bp, Artificial Sequence
  mutagenesis primer
  misc_feature (20)..(20): w is a or t
  misc_feature (21)..(21): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcaggwwggttgggscaggavcgacgcacgtggcttcrtcmtgtgtmtgaagaagaatggcgcgcaa

SEQ ID NO: 790 - DNA, 81 bp, Artificial Sequence
  mutagenesis primer
  misc_feature (20)..(20): w is a or t
  misc_feature (21)..(21): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwggttgggscaggavcgacgcacgtggcttcrtcmtgdccmtgaagaagaatggcgcgcaa

SEQ ID NO: 791 - DNA, 81 bp, Artificial Sequence
  mutagenesis primer
  misc_feature (20)..(20): w is a or t
  misc_feature (21)..(21): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcaggwwggttgggscaggavcgacarccgtggcttcrtcmtgtgtmtgaagaagaatggcgcgcaa

SEQ ID NO: 792 - DNA, 81 bp, Artificial Sequence
  mutagenesis primer
  misc_feature (20)..(20): w is a or t
  misc_feature (21)..(21): w is a or t
  misc_feature (29)..(29): s is g or c
  misc_feature (35)..(35): v is a, c or g
  misc_feature (41)..(41): r is a or g
  misc_feature (52)..(52): r is a or g
  misc_feature (55)..(55): m is a or c
  misc_feature (58)..(58): d is a, c or g
  misc_feature (61)..(61): m is a or c
gtcggtaacggcaagcaggwwggttgggscaggavcgacarccgtggcttcrtcmtgdccmtgaagaagaatggcgcgcaa

SEQ ID NO: 793 - DNA, 81 bp, Artificial Sequence
  mutagenesis primer
  misc_feature (20)..(20): w is a or t
  misc_feature (21)..(21): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcaggwwggttgggawaggavcgacgcacgtggcttcrtcmtgtgtmtgaagaagaatggcgcgcaa

SEQ ID NO: 794 - DNA, 81 bp, Artificial Sequence
  mutagenesis primer
  misc_feature (20)..(20): w is a or t
  misc_feature (21)..(21): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (58)..(58): d is a, c or g
  misc_feature (61)..(61): m is a or c
gtcggtaacggcaagcaggwwggttgggawaggavcgacgcacgtggcttcrtcmtgdccmtgaagaagaatggcgcgcaa

SEQ ID NO: 795 - DNA, 81 bp, Artificial Sequence
  mutagenesis primer
  misc_feature (20)..(20): w is a or t
  misc_feature (21)..(21): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcaggwwggttgggawaggavcgacarccgtggcttcrtcmtgtgtmtgaagaagaatggcgcgcaa

SEQ ID NO: 796 - DNA, 81 bp, Artificial Sequence
  mutagenesis primer
  misc_feature (20)..(20): w is a or t
  misc_feature (21)..(21): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwggttgggawaggavcgacarccgtggcttcrtcmtgdccmtgaagaagaatggcgcgcaa

SEQ ID NO: 797 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcaggwwwcttgggscaggavcgacgcacgtggcttcrtcmtgtgtmtgaagaagaatggcgcgcaa

SEQ ID NO: 798 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwwcttgggscaggavcgacgcacgtggcttcrtcmtgdccmtgaagaagaatggcgcgcaa

SEQ ID NO: 799 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcaggwwwcttgggscaggavcgacarccgtggcttcrtcmtgtgtmtgaagaagaatggcgcgcaa

SEQ ID NO: 800 - DNA, 81 bp, Artificial Sequence
  mutagenesis primer
  misc_feature (20)..(29): w is a or t
  misc_feature (21)..(21): w is a or t
  misc_feature (22)..(22): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwwcttgggscaggavcgacarccgtggcttcrtcmtgdccmtgaagaagaatggcgcgcaa

SEQ ID NO: 801 - DNA, 81 bp, Artificial Sequence
  mutagenesis primer
  misc_feature (20)..(20): w is a or t
  misc_feature (21)..(21): w is a or t
  misc_feature (22)..(212): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcaggwwwcttgggawaggavcgacgcacgtggcttcrtcmtgtgtmtgaagaagaatggcgcgcaa

SEQ ID NO: 802 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwwcttgggawaggavcgacgcacgtggcttcrtcmtgdccmtgaagaagaatggcgcgcaa

SEQ ID NO: 803 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcaggwwwcttgggawaggavcgacarccgtggcttcrtcmtgtgtmtgaagaagaatggcgcgcaa

SEQ ID NO: 804 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwwcttgggawaggavcgacarccgtggcttcrtcmtgdccmtgaagaagaatggcgcgcaa

SEQ ID NO: 805 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtaagttgggaaaggtccgacgcccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 806 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggttacttggggcaggagcgacgcacgtggcttcgtcctgggcctgaagaagaatggcgcgcaacacccttactacgttcaggccagcagcaaaattgaagtcgacaacaacgccgtgaaagatcagggccggttgatcgagccgctctcgtaa

SEQ ID NO: 807 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtcatgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 808 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaggttgggataggagcgacgcacgtggcttcgtcatgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 809 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctggggcaggaccgacaaccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 810 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtcctgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 811 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacaaccgtggcttcgtcatgtccctgaagaagaatggcgcgcaacacccttactacgttcaggccagcagcaaaattgaagtcgacaacaacgccgtgaaagatcagggccggttgatcgagccgctctcgtaa

SEQ ID NO: 812 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtatcttgggccaggagcgacagccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 813 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcagtgcggttgggataggagcgacagccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 814 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtaggttgggataggagcgacgcacgtggcttcgtcatggccctgaagaagaatggcgcgcaacacccttactacgttcaggccagcagcaaaattgaagtcgacaacaacgccgtgaaagatcagggccggttgatcgagccgctctcgtaa

SEQ ID NO: 815 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtaggttgggaaaggagcgacaaccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 816 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcagtgcggttgggataggaccgacaaccgtggcttcgtcatgtccctgaagaagaatggcgcgcaacacccttactacgttcaggccagcagcaaaattgaagtcgacaacaacgccgtgaaagatcagggccggttgatcgagccgctctcgtaa

SEQ ID NO: 817 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtttcttggggcaggagcgacgcacgtggcttcatcctgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 818 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaggttgggataggaccgacagccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 819 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggatacttgggccaggaccgacagccgtggcttcgtcatgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 820 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcagtgcacttggggcaggagcgacagccgtggcttcgtcatggccctgaagaagaatggcgcgcaacacccttactacgttcaggccagcagcaaaattgaagtcgacaacaacgccgtgaaagatcagggccggttgatcgagccgctctcgtaa

SEQ ID NO: 821 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcagtgctcttgggaaaggaccgacagccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 822 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtttcttgggccaggaacgacagccgtggcttcgtcctgtccctgaagaagaatggcgcgcaacacccttactacgttcaggccagcagcaaaattgaagtcgacaacaacgccgtgaaagatcagggccggttgatcgagccgctctcgtaa

SEQ ID NO: 823 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtaacttgggaaaggaccgacaaccgtggcttcgtcatgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 824 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggattcttgggataggagcgacgcacgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 825 - protein, 86 aa, Artificial Sequence
  PIP-72 polypeptide
MGITVTNNSSNPIEVAINHWGSDGDTSFFSVGNGKQVSWERSDARGFVLSLKKNGAQHPYYVQASSKIEVDNNAVKDQGRLIEPLS

SEQ ID NO: 826 - protein, 86 aa, Artificial Sequence
  PIP-72 polypeptide
MGITVTNNSSNPIEVAINHWGSDGDTSFFSVGNGKQVTWGRSDARGFVLGLKKNGAQHPYYVQASSKIEVDNNAVKDQGRLIEPLS

SEQ ID NO: 827 - protein, 86 aa, Artificial Sequence
  PIP-72 polypeptide
MGITVTNNSSNPIEVAINHWGSDGDTSFFSVGNGKQETWDRSDSRGFVMCMKKNGAQHPYYVQASSKIEVDNNAVKDQGRLIEPLS

SEQ ID NO: 828 - protein, 86 aa, Artificial Sequence
  PIP-72 polypeptide
MGITVTNNSSNPIEVAINHWGSDGDTSFFSVGNGKQEGWDRSDARGFVMCMKKNGAQHPYYVQASSKIEVDNNAVKDQGRLIEPLS

SEQ ID NO: 829 - protein, 86 aa, Artificial Sequence
  PIP-72 polypeptide
MGITVTNNSSNPIEVAINHWGSDGDTSFFSVGNGKQETWGRTDNRGFVLCLKKNGAQHPYYVQASSKIEVDNNAVKDQGRLIEPLS

SEQ ID NO: 830 - protein, 86 aa, Artificial Sequence
  PIP-72 polypeptide
MGITVTNNSSNPIEVAINHWGSDGDTSFFSVGNGKQETWDRSDSRGFVLCMKKNGAQHPYYVQASSKIEVDNNAVKDQGRLIEPLS

SEQ ID NO: 831 - protein, 86 aa, Artificial Sequence
  PIP-72 polypeptide
MGITVTNNSSNPIEVAINHWGSDGDTSFFSVGNGKQETWDRSDNRGFVMSLKKNGAQHPYYVQASSKIEVDNNAVKDQGRLIEPLS

SEQ ID NO: 832 - protein, 86 aa, Artificial Sequence
  PIP-72 polypeptide
MGITVTNNSSNPIEVAINHWGSDGDTSFFSVGNGKQVSWARSDSRGFVLCLKKNGAQHPYYVQASSKIEVDNNAVKDQGRLIEPLS

SEQ ID NO: 833 - protein, 86 aa, Artificial Sequence
  PIP-72 polypeptide
MGITVTNNSSNPIEVAINHWGSDGDTSFFSVGNGKQCGWDRSDSRGFVLCLKKNGAQHPYYVQASSKIEVDNNAVKDQGRLIEPLS

SEQ ID NO: 834 - protein, 86 aa, Artificial Sequence
  PIP-72 polypeptide
MGITVTNNSSNPIEVAINHWGSDGDTSFFSVGNGKQVGWDRSDARGFVMALKKNGAQHPYYVQASSKIEVDNNAVKDQGRLIEPLS

SEQ ID NO: 835 - protein, 86 aa, Artificial Sequence
  PIP-72 polypeptide
MGITVTNNSSNPIEVAINHWGSDGDTSFFSVGNGKQVGWERSDNRGFVLCLKKNGAQHPYYVQASSKIEVDNNAVKDQGRLIEPLS

SEQ ID NO: 836 - protein, 86 aa, Artificial Sequence
  PIP-72 polypeptide
MGITVTNNSSNPIEVAINHWGSDGDTSFFSVGNGKQCGWDRTDNRGFVMSLKKNGAQHPYYVQASSKIEVDNNAVKDQGRLIEPLS

SEQ ID NO: 837 - protein, 86 aa, Artificial Sequence
  PIP-72 polypeptide
MGITVTNNSSNPIEVAINHWGSDGDTSFFSVGNGKQVSWGRSDARGFILCMKKNGAQHPYYVQASSKIEVDNNAVKDQGRLIEPLS

SEQ ID NO: 838 - protein, 86 aa, Artificial Sequence
  PIP-72 polypeptide
MGITVTNNSSNPIEVAINHWGSDGDTSFFSVGNGKQEGWDRTDSRGFVLCLKKNGAQHPYYVQASSKIEVDNNAVKDQGRLIEPLS

SEQ ID NO: 839 - protein, 86 aa, Artificial Sequence
  PIP-72 polypeptide
MGITVTNNSSNPIEVAINHWGSDGDTSFFSVGNGKQDTWARTDSRGFVMCLKKNGAQHPYYVQASSKIEVDNNAVKDQGRLIEPLS

SEQ ID NO: 840 - protein, 86 aa, Artificial Sequence
  PIP-72 polypeptide
MGITVTNNSSNPIEVAINHWGSDGDTSFFSVGNGKQCTWGRSDSRGFVMALKKNGAQHPYYVQASSKIEVDNNAVKDQGRLIEPLS

SEQ ID NO: 841 - protein, 86 aa, Artificial Sequence
  PIP-72 polypeptide
MGITVTNNSSNPIEVAINHWGSDGDTSFFSVGNGKQCSWERTDSRGFVLCLKKNGAQHPYYVQASSKIEVDNNAVKDQGRLIEPLS

SEQ ID NO: 842 - protein, 86 aa, Artificial Sequence
  PIP-72 polypeptide
MGITVTNNSSNPIEVAINHWGSDGDTSFFSVGNGKQVSWARNDSRGFVLSLKKNGAQHPYYVQASSKIEVDNNAVKDQGRLIEPLS

SEQ ID NO: 843 - protein, 86 aa, Artificial Sequence
  PIP-72 polypeptide
MGITVTNNSSNPIEVAINHWGSDGDTSFFSVGNGKQVTWERTDNRGFVMCMKKNGAQHPYYVQASSKIEVDNNAVKDQGRLIEPLS

SEQ ID NO: 844 - protein, 86 aa, Artificial Sequence
  PIP-72 polypeptide
MGITVTNNSSNPIEVAINHWGSDGDTSFFSVGNGKQDSWDRSDARGFVLCLKKNGAQHPYYVQASSKIEVDNNAVKDQGRLIEPLS

SEQ ID NO: 845 - DNA, 261 bp, Artificial Sequence
  Coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 846 - protein, 86 aa, Artificial Sequence
  test
  misc_feature (2)..(2): Xaa at position 2 is Gly, Ala, Cys, Asp, Glu, Ile, Lys, Leu, Asn, Arg, Ser, Thr, Val, Trp or Tyr
  misc_feature (3)..(3): Xaa at position 3 is Ile or Trp
  misc_feature (4)..(4): Xaa at position 4 is Thr, Ala, Asp, Glu, His, Ile, Lys, Leu, Arg, Ser, Val, Trp or Tyr
  misc_feature (5)..(5): Xaa at position 5 is Val, Ala, Cys, Gly, His, Ile or Tyr
  misc_feature (6)..(6): Xaa at position 6 is Thr, Ala, Cys, Phe, Gly, His, Ile, Lys, Met, Pro, Gln, Arg, Ser, Trp or Tyr
  misc_feature (7)..(7): Xaa at position 7 is Asn, Ala or Val
  misc_feature (8)..(8): Xaa at position 8 is Asn, Ala, Cys, Asp, Glu, Gly, His, Ile, Lys, Leu, Met, Gln, Arg, Ser, Thr or Val
  misc_feature (9)..(9): Xaa at position 9 is Ser, Ala, Cys, Gly or Thr
  misc_feature (10)..(10): Xaa at position 10 is Ser, Ala, Glu, Phe, Gly, His, Ile, Lys, Leu, Asn, Pro, Gln, Arg, Thr or Trp
  misc_feature (11)..(11): Xaa at position 11 is Asn, Ala, Cys, Asp, Glu, Gly, His, Ile, Lys, Leu, Met, Gln, Ser, Thr, Val or Tyr
  misc_feature (12)..(12): Xaa at position 12 is Pro, Ala, Cys, Asp, Glu, Gly, His, Lys, Leu, Asn, Gln, Arg, Ser, Thr, Val, Trp or Tyr
  misc_feature (13)..(13): Xaa at position 13 is Ile, Asn, Gln or Val
  misc_feature (14)..(14): Xaa at position 14 is Glu, Ala, Cys, Phe, His, Lys or G
  misc_feature (15)..(15): Xaa at position 15 is Val, Ala, Cys, Ile, Met or Arg
  misc_feature (17)..(17): Xaa at position 17 is Ile, Glu or Val
  misc_feature (18)..(18): Xaa at position 18 is Asn or Ser
  misc_feature (19)..(19)
  misc_feature (20)..(20): Xaa at position 20 is Trp, Ala or Thr
  misc_feature (22)..(22): Xaa at position 22 is Ser, Ala, Asp, Phe, Gly, His, Ile, Lys, Leu, Met, Asn, Pro, Gln, Arg, Thr, Val or Tyr
  misc_feature (23)..(23): Xaa at position 23 is Asp, Ala, Gly, His, Lys, Met, Asn, Gln, Ser, Thr or Val
  misc_feature (24)..(24): Xaa at position 24 is Gly, Asp or Phe
  misc_feature (25)..(25): Xaa at position 25 is Asp, Ala, Glu, Phe, Asn or Gln
  misc_feature (26)..(26): Xaa at position 26 is Thr, Glu or Pro
  misc_feature (27)..(27): Xaa at position 27 is Ser, Ala, Cys, Asp, Glu, Phe, Gly, His, Asn, Gln, Arg or Thr
  misc_feature (28)..(28): Xaa at position 28 is Phe, Pro, Trp or Tyr
  misc_feature (29)..(29): Xaa at position 29 is Phe, Ala, Cys, Ile, Leu, Gln, Arg, Trp or Tyr
  misc_feature (30)..(30): Xaa at position 30 is Ser, Ala, Cys, Asp, Glu, Phe, Gly, His, Lys, Leu, Met, Asn, Pro, Gln, Arg, Thr, Val, Trp or Tyr
  misc_feature (31)..(31): Xaa at position 31 is Val, Ile or Leu
  misc_feature (32)..(32): Xaa at position 32 is Gly, Ala, Asp, Glu, Phe, His, Lys, Leu, Met, Asn, Pro, Gln, Arg, Ser, Thr, Val, Trp or Tyr
  misc_feature (33)..(33): Xaa at position 33 is Asn, Ala, Cys, Asp, Glu, Phe, Gly, His, Ile, Lys, Leu, Pro, Gln, Arg, Ser, Thr, Val or Tyr
  misc_feature (34)..(34): Xaa at position 34 is Gly, Glu, Phe, His, Lys, Leu, Met, Asn, Gln, Arg, Ser, Thr or Tyr
  misc_feature (35)..(35): Xaa at position 35 is Lys, Ala, Cys, Asp, Gly, His, Ile, Leu, Met, Asn, Gln, Arg, Ser, Thr or Val
  misc_feature (36)..(36): Xaa at position 36 is Gln, Ala, Cys, Glu, Gly, His, Ile, Lys, Leu, Asn, Pro, Arg, Ser, Thr or Val
  misc_feature (37)..(37): Xaa at position 37 is Glu, Ala, Cys, Asp, Phe, Gly, Ile, Lys, Leu, Met, Asn, Ser, Thr or Val
  misc_feature (38)..(38): Xaa at position 38 is Thr, Ala, Cys, Asp, Glu, Phe, Gly, His, Ile, Leu, Met, Asn, Gln, Arg, Ser, Val, Trp or Tyr
  misc_feature (39)..(39): Xaa at position 39 is Trp or Phe
  misc_feature (40)..(40): Xaa at position 40 is Asp, Ala, Cys, Glu, Phe, Gly, His, Ile, Lys, Leu, Met, Asn, Gln, Arg, Ser, Thr, Val, Trp or Tyr
  misc_feature (42)..(42): Xaa at position 42 is Ser, Ala, Cys, Asp, Glu, Phe, Gly, Ile, Lys, Leu, Met, Asn, Gln, Arg, Thr, Val, Trp or Tyr
  misc_feature (44)..(44): Xaa at position 44 is Ser, Ala, Asp, Glu, Gly, Leu, Met, Asn, Pro, Gln, Thr, Val or Tyr
  misc_feature (45)..(45): Xaa at position 45 is Arg, Lys or Ser
  misc_feature (46)..(46): Xaa at position 46 is Gly, Ala or Gln
  misc_feature (47)..(47): Xaa at position 47 is Phe, Cys, Val or Tyr
  misc_feature (48)..(48): Xaa at position 48 is Val, Ile or Leu
  misc_feature (49)..(49): Xaa at position 49 is Leu, Cys, Phe, Met, Arg or Tyr
  misc_feature (50)..(50): Xaa at position 50 is Ser, Ala, Cys, Asp, Ile, Met, Pro, Gln, Thr or Val
  misc_feature (51)..(51): Xaa at position 51 is Leu, Ala, Cys, Met or Val
  misc_feature (52)..(52): Xaa at position 52 is Lys, Cys, Phe, His, Ile, Leu, Met, Asn, Arg, Ser, Thr, Trp or Tyr
  misc_feature (53)..(53): Xaa at position 53 is Lys, Ala, Cys, Asp, Glu, Phe, His, Ile, Leu, Met, Asn, Gln, Arg, Ser, Thr, Val or Tyr
  misc_feature (54)..(54): Xaa at position 54 is Asn, Cys, Asp, Glu, Phe, Gly, Lys, Met, Gln, Arg, Ser or Trp
  misc_feature (56)..(56): Xaa at position 56 is Ala, Gly, Leu, Asn, Pro, Gln, Arg, Ser or Thr
  misc_feature (57)..(57): Xaa at position 57 is Gln, Glu, Leu, Met, Ser or Thr
  misc_feature (58)..(58): Xaa at position 58 is His, Ala, Asp, Phe, Leu, Met, Asn, Arg, Trp or Tyr
  misc_feature (60)..(60): Xaa at position 60 is Tyr, Glu or Phe
  misc_feature (63)..(63): Xaa at position 63 is Gln, Cys, Gly, Ile, Leu, Met, Asn, Thr, Val or Tyr
  misc_feature (64)..(64): Xaa at position 64 is Ala, Phe, Gly, His, Arg, Ser or Tyr
  misc_feature (65)..(65): Xaa at position 65 is Ser, Ala, Cys, Asp, Glu, Phe, Gly, His, Ile, Leu, Asn, Thr or Val
  misc_feature (66)..(66): Xaa at position 66 is Ser, Ala or Gly
  misc_feature (67)..(67): Xaa at position 67 is Lys, Ala, Cys, Asp, Phe, His, Ile, Leu, Met, Asn, Gln, Arg, Ser, Thr, Val, Trp or Tyr
  misc_feature (68)..(68): Xaa at position 68 is Ile Asp, Leu or Val
  misc_feature (69)..(69): Xaa at position 69 is Glu, Ala, Cys, Asp, Phe, His, Ile, Leu, Met, Gln, Arg, Ser, Thr, Val or Tyr
  misc_feature (70)..(70): Xaa at position 70 is Val, Cys or Ile
  misc_feature (71)..(71): Xaa at position 71 is Asp, Ala, Cys, Gly, His, Ile, Leu, Met, Asn, Ser, Thr, Val or Tyr
  misc_feature (72)..(72): Xaa at position 72 is Asn, Ala, Cys, Asp, Glu, Gly, Lys, Met, Pro, Gln, Arg, Ser, Thr, Val or Trp
  misc_feature (73)..(73): Xaa at position 73 is Asn, Ala, Cys, Asp, Phe, Gly, His, Ile, Leu, Ser, Thr, Val or Tyr
  misc_feature (74)..(74): Xaa at position 74 is Ala, Cys, Asp, Phe, Gly, His, Ile, Leu, Asn, Gln, Arg, Ser, Thr, Val or Tyr
  misc_feature (75)..(75): Xaa at position 75 is Val, Cys, Ile or Leu
  misc_feature (76)..(76): Xaa at position 76 is Lys, Ala, Cys, Phe, His, Ile, Leu, Gln, Arg, Ser, Thr, Val, Trp or Tyr
  misc_feature (77)..(77): Xaa at position 77 is Asp Tyr
  misc_feature (78)..(78): Xaa at position 78 is Gln, Ala, Cys, Asp, Phe, Gly, His, Ile, Leu, Met, Asn, Arg, Ser, Thr, Val or Tyr
  misc_feature (79)..(79): Xaa at position 79 is Gly, Arg, Ala, Cys, Asp, Glu, Phe, His, Lys, Leu, Asn, Gln, Arg, Ser, Thr, Trp or Tyr
  misc_feature (80)..(80): Xaa at position 80 is Arg, Ala, Cys, Asp, Phe, Gly, His, Ile, Leu, Asn, Ser, Thr, Val or Tyr
  misc_feature (81)..(81): Xaa at position 81 is Leu, Ala, Cys, Asp, Phe, Gly, His, Ile, Asn, Pro, Arg, Ser, Thr or Val
  misc_feature (82)..(82): Xaa at position 82 is Ile, Ala, Leu, Met, Arg and Val
  misc_feature (82)..(82): Xaa at position 82 is Ile, Ala, Leu, Met, Arg or Val
  misc_feature (83)..(83): Xaa at position 83 is Glu, Ala, Cys, Asp, Phe, Gly, His, Ile, Lys, Leu, Asn, Pro, Arg, Ser, Thr, Val or Tyr
  misc_feature (84)..(84): Xaa at position 84 is Pro, Ala, Cys, Glu, Ile, Ser, Val, Trp or Tyr
  misc_feature (85)..(85): Xaa at position 85 is Leu, Cys, Gly or Val
  misc_feature (86)..(86): Xaa at position 86 is Ser, Ala, Ile, Thr or Val
MXXXXXXXXXXXXXXAXXXXGXXXXXXXXXXXXXXXXXXXRXDXXXXXXXXXXXGXXXPXYVXXXXXXXXXXXXXXXXXXXXXXXX

SEQ ID NO: 847 - protein, 86 aa, Artificial Sequence
  pip
  misc_feature (2)..(2): Xaa at position 2 is Gly, Lys or Ala
  misc_feature (3)..(3): Xaa at position 3 is Ile or Leu
  misc_feature (4)..(4): Xaa at position 4 is Thr or Ser
  misc_feature (5)..(5): Xaa at position 5 is Val or Ile
  misc_feature (6)..(6): Xaa at position 6 is Thr or Lys
  misc_feature (8)..(8): Xaa at position 8 is Asn, Lys, Gly or Ser
  misc_feature (9)..(9): Xaa at position 9 is Ser or Ala
  misc_feature (11)..(11): Xaa at position 11 is Asn, Lys, His or Thr
  misc_feature (12)..(12): Xaa at position 12 is Pro, Thr, Lys or Ser
  misc_feature (13)..(13): Xaa at position 13 is Ile or Val
  misc_feature (14)..(14): Xaa at position 14 is Glu or Asp
  misc_feature (15)..(15): Xaa at position 15 is Val, Ala or Ile
  misc_feature (16)..(16): Xaa at position 16 is Ala or Ser
  misc_feature (17)..(17): Xaa at position 17 is Ile or Val
  misc_feature (18)..(18): Xaa at position 18 is Asn or Ser
  misc_feature (19)..(19): Xaa at position 19 is His, Lys, Arg, Gln or Ala
  misc_feature (21)..(21): Xaa at position 21 is Gly or Arg
  misc_feature (22)..(22): Xaa at position 22 is Ser, Lys, Asn, Asp or Thr
  misc_feature (25)..(25): Xaa at position 25 is Asp or Asn
  misc_feature (26)..(26): Xaa at position 26 is Thr or Asp
  misc_feature (27)..(27): Xaa at position 27 is Ser, Thr, Asn or Lys
  misc_feature (28)..(28): Xaa at position 28 is Phe, Tyr or Pro
  misc_feature (29)..(29): Xaa at position 29 is Phe or Tyr
  misc_feature (30)..(30): Xaa at position 30 is Ser, Gly or Lys
  misc_feature (31)..(31): Xaa at position 31 is Val, Ile or Met
  misc_feature (32)..(32): Xaa at position 32 is Gly, Ala or Asp
  misc_feature (33)..(33): Xaa at position 33 is Asn, Ser, Gln or Pro
  misc_feature (35)..(35): Xaa at position 35 is Lys, Glu or Ser
  misc_feature (36)..(36): Xaa at position 36 is Gln, Asn or Ser
  misc_feature (37)..(37): Xaa at position 37 is Glu or Asp
  misc_feature (38)..(38): Xaa at position 38 is Thr or Ser
  misc_feature (42)..(42): Xaa at position 42 is Ser or Asn
  misc_feature (44)..(44): Xaa at position 44 is Ser, Asp, Ala or Leu
  misc_feature (47)..(47): Xaa at position 47 is Phe or Tyr
  misc_feature (48)..(48): Xaa at position 48 is Leu or Met
  misc_feature (49)..(49): Xaa at position 49 is Leu or Met
  misc_feature (50)..(50): Xaa at position 50 is Ser, Ala or Tyr
  misc_feature (51)..(51): Xaa at position 51 is Leu or Val
  misc_feature (52)..(52): Xaa at position 52 is Lys or Gln
  misc_feature (53)..(53): Xaa at position 53 is Lys, Arg, Met or Leu
  misc_feature (54)..(54): Xaa at position 54 is Asn, Lys or Gly
  misc_feature (55)..(55): Xaa at position 55 is Gly or Ser
  misc_feature (56)..(56): Xaa at position 56 is Ala, Thr, Gln or Ser
  misc_feature (57)..(57): Xaa at position 57 is Gln, Val or Ala
  misc_feature (58)..(58): Xaa at position 58 is His, Ala, Lys, Tyr or Thr
  misc_feature (59)..(59): Xaa at position 59 is Pro or Thr
  misc_feature (62)..(62): Xaa at position 62 is Val or Ile
  misc_feature (63)..(63): Xaa at position 63 is Gln, Ser or Leu
  misc_feature (64)..(64): Xaa at position 64 is Ala, Gln or Ser
  misc_feature (65)..(65): Xaa at position 65 is Ser or Thr
  misc_feature (67)..(67): Xaa at position 67 is Lys, Gln, Arg or Asn
  misc_feature (69)..(69): Xaa at position 69 is Glu, Lys or Val
  misc_feature (70)..(70): Xaa at position 70 is Val or Ile
  misc_feature (71)..(71): Xaa at position 71 is Asp, Glu or Tyr
  misc_feature (72)..(72): Xaa at position 72 is Asn, His, Ser or Asp
  misc_feature (73)..(73): Xaa at position 73 is Asn, Ser or Asp
  misc_feature (74)..(74): Xaa at position 74 is Ala, Thr, Met, Ile or Lys
  misc_feature (76)..(76): Xaa at position 76 is Lys or Thr
  misc_feature (78)..(78): Xaa at position 78 is Gln, His or Ser
  misc_feature (80)..(80): Xaa at position 80 is Arg, Glu or Gln
  misc_feature (81)..(81): Xaa at position 81 is Leu, Pro, Ala or Thr
  misc_feature (82)..(82): Xaa at position 82 is Ile or Leu
  misc_feature (83)..(83): Xaa at position 83 is Glu, His, Asn, Gln or Leu
  misc_feature (85)..(85): Xaa at position 85 is Leu, Val or Ala
  misc_feature (86)..(86): Xaa at position 86 is Ser, Ala, Tyr or Asn
MXXXXXNXXSXXXXXXXXXWXXDGXXXXXXXXXGXXXXWDRXDXRGXXXXXXXXXXXXXYYXXXXSXIXXXXXXVXDXGXXXXPXX

SEQ ID NO: 848 - protein, 86 aa, Artificial Sequence; identical to SEQ ID NO: 847
  pip
  misc_feature (2)..(2): Xaa at position 2 is Gly, Lys, Ala or Arg
  misc_feature (3)..(3): Xaa at position 3 is Ile, Leu or Val
  misc_feature (4)..(4): Xaa at position 4 is Thr or Ser
  misc_feature (5)..(5): Xaa at position 5 is Val, Ile or Leu
  misc_feature (6)..(6): Xaa at position 6 is Thr, Lys, Ser or Arg
  misc_feature (8)..(8): Xaa at position 8 is Asn, Lys, Gly, Ser, Gln, Arg, Thr or Ala
  misc_feature (9)..(9): Xaa at position 9 is Ser, Ala or Thr
  misc_feature (11)..(11): Xaa at position 11 is Asn, Lys, Thr, Gln, Arg, His or Ser
  misc_feature (12)..(12): Xaa at position 12 is Pro, Thr, Lys, Ser or Arg
  misc_feature (13)..(13): Xaa at position 13 is Ile, Val or Leu
  misc_feature (14)..(14): Xaa at position 14 is Glu or Asp
  misc_feature (15)..(15): Xaa at position 15 is Val, Ala, Ile or Leu
  misc_feature (16)..(16): Xaa at position 16 is Ala or Ser
  misc_feature (17)..(17): Xaa at position 17 is Ile, Val or Leu
  misc_feature (18)..(18): Xaa at position 18 is Asn, Ser, Gln or Thr
  misc_feature (19)..(19): Xaa at position 19 is His, Lys, Ala, Gln, Asn or Arg
  misc_feature (21)..(21): Xaa at position 21 is Gly, Arg or Lys
  misc_feature (22)..(22): Xaa at position 22 is Ser, Lys, Asn, Thr, Arg, Asp, Glu or Gln
  misc_feature (25)..(25): Xaa at position 25 is Asp, Asn, Glu or Gln
  misc_feature (26)..(26): Xaa at position 26 is Thr, Asp, Ser or Glu
  misc_feature (27)..(27): Xaa at position 27 is Ser, Thr, Lys, Asn, Gln or Arg
  misc_feature (28)..(28): Xaa at position 28 is Phe, Tyr, Pro or Trp
  misc_feature (29)..(29): Xaa at position 29 is Phe, Tyr or Trp
  misc_feature (30)..(30): Xaa at position 30 is Ser, Gly, Lys, Thr or Arg
  misc_feature (31)..(31): Xaa at position 31 is Val, Ile, Met or Leu
  misc_feature (32)..(32): Xaa at position 32 is Gly, Ala, Asp or Glu
  misc_feature (33)..(33): Xaa at position 33 is Asn, Ser, Gln, Pro or Thr
  misc_feature (35)..(35): Xaa at position 35 is Lys, Glu, Ser, Arg or Thr
  misc_feature (36)..(36): Xaa at position 36 is Gln, Ser, Asn or Thr
  misc_feature (37)..(37): Xaa at position 37 is Glu or Asp
  misc_feature (38)..(38): Xaa at position 38 is Thr or Ser
  misc_feature (42)..(42): Xaa at position 42 is Ser, Asn, Thr or Gln
  misc_feature (44)..(44): Xaa at position 44 is Ser, Asp, Ala, Leu, Thr, Glu, Ile or Val
  misc_feature (47)..(47): Xaa at position 47 is Phe, Tyr or Trp
  misc_feature (48)..(48): Xaa at position 48 is Leu, Met, Ile or Val
  misc_feature (49)..(49): Xaa at position 49 is Leu, Met, Ile or Val
  misc_feature (50)..(50): Xaa at position 50 is Ser, Ala, Tyr or Thr
  misc_feature (51)..(51): Xaa at position 51 is Leu, Val or Ile
  misc_feature (52)..(52): Xaa at position 52 is Lys, Gln, Arg or Asn
  misc_feature (53)..(53): Xaa at position 53 is Lys, Arg, Met, Leu, Ile or Val
  misc_feature (54)..(54): Xaa at position 54 is Asn, Lys, Gly, Gln or Arg
  misc_feature (55)..(55): Xaa at position 55 is Gly, Ser or Thr
  misc_feature (56)..(56): Xaa at position 56 is Ala, Thr, Gln, Ser or Asn
  misc_feature (57)..(57): Xaa at position 57 is Gln, Val, Ala, Asn, Leu or Ile
  misc_feature (58)..(58): Xaa at position 58 is His, Ala, Lys, Tyr or Thr
  misc_feature (59)..(59): Xaa at position 59 is Pro, Thr or Ser
  misc_feature (62)..(62): Xaa at position 62 is Val, Ile or Leu
  misc_feature (63)..(63): Xaa at position 63 is Gln, Ser, Leu, Asn, Thr, Ile or Val
  misc_feature (64)..(64): Xaa at position 64 is Ala, Gln, Ser, Asn or Thr
  misc_feature (65)..(65): Xaa at position 65 is Ser or Thr
  misc_feature (67)..(67): Xaa at position 67 is Lys, Gln, Asn or Arg
  misc_feature (69)..(69): Xaa at position 69 is Glu, Val, Asp, Lys, Arg, Ile or Leu
  misc_feature (70)..(70): Xaa at position 70 is Val, Ile or Leu
  misc_feature (71)..(71): Xaa at position 71 is Asp, Glu, Tyr or Trp
  misc_feature (72)..(72): Xaa at position 72 is Asn, His, Ser, Asp, Gln, Thr or Glu
  misc_feature (73)..(73): Xaa at position 73 is Asn, Ser, Asp, Gln, Thr or Glu
  misc_feature (74)..(74): Xaa at position 74 is Ala, Thr, Met, Ile, Lys, Ser, Leu, Val or Arg
  misc_feature (76)..(76): Xaa at position 76 is Lys, Thr, Arg or Ser
  misc_feature (78)..(78): Xaa at position 78 is Gln, His, Ser, Asn or Thr
  misc_feature (80)..(80): Xaa at position 80 is Arg, Glu, Gln, Lys, Asp or Asn
  misc_feature (81)..(81): Xaa at position 81 is Leu, Pro, Thr, Ile, Val, Ala or Ser
  misc_feature (82)..(82): Xaa at position 82 is Ile, Leu or Val
  misc_feature (83)..(83): Xaa at position 83 is Glu, His, Asn, Leu, Gln, Ile or Val
  misc_feature (85)..(85): Xaa at position 85 is Leu, Val or Ala
  misc_feature (86)..(86): Xaa at position 86 is Ser, Ala, Tyr, Asn or Thr

SEQ ID NO: 849 - protein, 86 aa, Artificial Sequence
  PIP-72 polypeptide
  misc_feature (2)..(2): Xaa at position 2 is Gly, Ala, Cys, Asp, Glu, Ile, Lys, Leu, Asn, Arg, Ser, Thr, Val, Trp or Tyr
  misc_feature (3)..(3): Xaa at position 3 is Ile, Leu, Val or Trp
  misc_feature (4)..(4): Xaa at position 4 is Thr, Ala, Asp, Glu, His, Ile, Lys, Leu, Arg, Ser, Val, Trp or Tyr
  misc_feature (5)..(5): Xaa at position 5 is Val, Ala, Cys, Gly, His, Ile, Leu or Tyr
  misc_feature (6)..(6): Xaa at position 6 is Thr, Ala, Cys, Phe, Gly, His, Ile, Lys, Met, Pro, Gln, Arg, Ser, Trp or Tyr
  misc_feature (7)..(7): Xaa at position 7 is Asn, Ala or Val
  misc_feature (8)..(8): Xaa at position 8 is Asn, Lys, Gly, Ser, Gln, Arg, Thr, Ala, Cys, Asp, Glu, His, Ile, Leu, Met or Val
  misc_feature (9)..(9): Xaa at position 9 is Ser, Ala, Cys, Gly or Thr
  misc_feature (11)..(11): Xaa at position 11 is Asn, Lys, Thr, Gln, Arg, Ser, Ala, Cys, Asp, Glu, Gly, His, Ile, Leu, Met, Val or Tyr
  misc_feature (12)..(12): Xaa at position 12 is Pro, Thr, Lys, Ser, Arg, Ala, Cys, Asp, Glu, Gly, His, Leu, Asn, Gln, Arg, Val, Trp or Tyr
  misc_feature (13)..(13): Xaa at position 13 is Ile, Asn, Gln, Leu or Val
  misc_feature (14)..(14): Xaa at position 14 is Glu, Ala, Cys, Phe, His, Lys or Gln
  misc_feature (15)..(15): Xaa at position 15 is Val, Ala, Ile, Leu, Cys, Met or Arg
  misc_feature (16)..(16): Xaa at position 16 is Ala or Ser
  misc_feature (17)..(17): Xaa at position 17 is Ile, Glu, Leu or Val
  misc_feature (18)..(18): Xaa at position 18 is Asn, Gln, Thr or Ser
  misc_feature (19)..(19): Xaa at position 19 is His, Lys, Ala, Arg, Glu, Leu, Pro, Ser or Tyr
  misc_feature (20)..(20): Xaa at position 20 is Trp, Ala or Thr
  misc_feature (21)..(21): Xaa at position 21 is Gly, Arg or Lys
  misc_feature (22)..(22): Xaa at position 22 is Ser, Ala, Asp, Phe, Gly, His, Ile, Lys, Leu, Met, Asn, Pro, Gln, Arg, Thr, Val or Tyr
  misc_feature (23)..(23): Xaa at position 23 is Asp, Ala, Gly, His, Lys, Met, Asn, Gln, Ser, Thr or Val
  misc_feature (24)..(24): Xaa at position 24 is Gly, Asp or Phe
  misc_feature (25)..(25): Xaa at position 25 is Asp, Ala, Glu, Phe, Asn or Gln
  misc_feature (26)..(26): Xaa at position 26 is Thr, Glu, Asp, Ser or Pro
  misc_feature (27)..(27): Xaa at position 27 is Ser, Thr, Lys, Arg, Ala, Cys, Asp, Glu, Phe, Gly, His, Asn or Gln
  misc_feature (28)..(28): Xaa at position 28 is Phe, Tyr, Pro or Trp
  misc_feature (29)..(29): Xaa at position 29 is Phe, Ala, Cys, Ile, Leu, Gln, Arg, Trp or Tyr
  misc_feature (30)..(30): Xaa at position 30 is Ser, Gly, Lys, Thr, Arg, Ala, Cys, Asp, Glu, Phe, His, Leu, Met, Asn, Pro, Gln, Val, Trp or Tyr
  misc_feature (31)..(31): Xaa at position 31 is Val, Ile, Met or Leu
  misc_feature (32)..(32): Xaa at position 32 is Gly, Ala, Asp, Glu, Phe, His, Lys, Leu, Met, Asn, Pro, Gln, Arg, Ser, Thr, Val, Trp or Tyr
  misc_feature (33)..(33): Xaa at position 33 is Asn, Ser, Gln, Pro, Thr, Ala, Cys, Asp, Glu, Phe, Gly, His, Ile, Lys, Leu, Arg, Val or Tyr
  misc_feature (34)..(34): Xaa at position 34 is Gly, Glu, Phe, His, Lys, Leu, Met, Asn, Gln, Arg, Ser, Thr or Tyr
  misc_feature (35)..(35): Xaa at position 35 is Lys, Glu, Ala, Cys, Asp, Gly, His, Ile, Leu, Met, Asn, Gln, Arg, Ser, Thr or Val
  misc_feature (36)..(36): Xaa at position 36 is Gln, Ala, Cys, Glu, Gly, His, Ile, Lys, Leu, Asn, Pro, Arg, Ser, Thr or Val
  misc_feature (37)..(37): Xaa at position 37 is Glu, Asp, Ala, Cys, Phe, Gly, Ile, Lys, Leu, Met, Asn, Ser, Thr or Val
  misc_feature (38)..(38): Xaa at position 38 is Thr, Ser, Ala, Cys, Asp, Glu, Phe, Gly, His, Ile, Leu, Met, Asn, Gln, Arg, Val, Trp or Tyr
  misc_feature (39)..(39): Xaa at position 39 is Trp or Phe
  misc_feature (40)..(40): Xaa at position 40 is Asp, Ala, Cys, Glu, Phe, Gly, His, Ile, Lys, Leu, Met, Asn, Gln, Arg, Ser, Thr, Val, Trp or Tyr
  misc_feature (42)..(42): Xaa at position 42 is Ser, Asn, Thr, Ala, Cys, Asp, Glu, Phe, Gly, Ile, Lys, Leu, Met, Arg, Val, Trp, Tyr or Gln
  misc_feature (44)..(44): Xaa at position 44 is Ser, Asp, Ala, Leu, Thr, Glu, Ile, Ala, Gly, Leu, Met, Asn, Pro, Gln, Val, Tyr or Val
  misc_feature (45)..(45): Xaa at position 45 is Arg, Lys or Ser
  misc_feature (46)..(46): Xaa at position 46 is Gly, Ala or Gln
  misc_feature (47)..(47): Xaa at position 47 is Phe, Tyr Cys, Val or Trp
  misc_feature (48)..(48): Xaa at position 48 is Leu, Met, Ile, Cys, Phe, Met, Arg, Tyr or Val
  misc_feature (49)..(49): Xaa at position 49 is Leu, Met, Ile or Val
  misc_feature (50)..(50): Xaa at position 50 is Ser, Ala, Tyr, Cys, Asp, Ile, Met, Pro, Gln, Val or Thr
  misc_feature (51)..(51): Xaa at position 51 is Leu, Val, Ala, Cys, Met or Ile
  misc_feature (52)..(52): Xaa at position 52 is Lys, Cys, Phe, His, Ile, Leu, Met, Asn, Arg, Ser, Thr, Trp or Tyr
  misc_feature (53)..(53): Xaa at position 53 is Lys, Arg, Met, Leu, Ile, Ala, Cys, Asp, Glu, Phe, His, Asn, Gln, Ser, Thr, Tyr or Val
  misc_feature (54)..(54): Xaa at position 54 is Asn, Cys, Asp, Glu, Phe, Gly, Lys, Met, Gln, Arg, Ser or Trp
  misc_feature (55)..(55): Xaa at position 55 is Gly, Ser or Thr
  misc_feature (56)..(56): Xaa at position 56 is Ala, Thr, Gln, Ser, Gly, Leu, Pro, Arg or Asn
  misc_feature (57)..(57): Xaa at position 57 is Gln, Glu, Leu, Met, Val, Ala, Asn,  Ile, Ser or Thr
  misc_feature (58)..(58): Xaa at position 58 is His, Ala, Lys, Asp, Phe, Leu, Met, Asn, Arg, Trp, Tyr or Thr
  misc_feature (59)..(59): Xaa at position 59 is Pro, Thr or Ser
  misc_feature (60)..(60): Xaa at position 60 is Tyr, Glu or Phe
  misc_feature (62)..(62): Xaa at position 62 is Val, Ile or Leu
  misc_feature (63)..(63): Xaa at position 63 is Gln, Ser, Leu, Asn, Thr, Ile or Val
  misc_feature (64)..(64): Xaa at position 64 is Ala, Gln, Asn, Phe, Gly, His, Arg, Ser or Tyr
  misc_feature (65)..(65): Xaa at position 65 is Ser, Ala, Cys, Asp, Glu, Phe, Gly, His, Ile, Leu, Asn, Val or Thr
  misc_feature (66)..(66): Xaa at position 66 is Ser, Ala or Gly
  misc_feature (67)..(67): Xaa at position 67 is Lys, Gln, Asn or Arg
  misc_feature (68)..(68): Xaa at position 68 is Ile Asp, Leu or Val
  misc_feature (69)..(69): Xaa at position 69 is Glu, Ala, Cys, Asp, Phe, His, Ile, Leu, Met, Gln, Arg, Ser, Thr, Val or Tyr
  misc_feature (70)..(70): Xaa at position 70 is Val, Ile, Cys or Leu
  misc_feature (71)..(71): Xaa at position 71 is Asp, Glu, Tyr, Ala, Cys, Gly, His, Ile, Leu, Met, Asn, Ser, Thr, Val or Trp
  misc_feature (72)..(72): Xaa at position 72 is Asn, Ala, Cys, Asp, Glu, Gly, Lys, Met, Pro, Gln, Arg, Ser, Thr, Val, His or Trp
  misc_feature (73)..(73): Xaa at position 73 is Asn, Ser, Asp, Gln, Thr, Ala, Cys, Phe, Gly, His, Ile, Leu, Val, Tyr or Glu
  misc_feature (74)..(74): Xaa at position 74 is Ala, Thr, Met, Ile, Lys, Ser, Leu, Val, Cys, Asp, Phe, Gly, His, Asn, Gln, Tyr or Arg
  misc_feature (75)..(75): Xaa at position 75 is Val, Cys, Ile or Leu
  misc_feature (76)..(76): Xaa at position 76 is Lys, Ala, Cys, Phe, His, Ile, Leu, Gln, Arg, Ser, Thr, Val, Trp or Tyr
  misc_feature (77)..(77): Xaa at position 77 is Asp Tyr
  misc_feature (78)..(78): Xaa at position 78 is Gln, His, Ser, Asn, Ala, Cys, Asp, Phe, Gly, Ile, Leu, Met, Asn, Arg, Val, Tyr or Thr
  misc_feature (79)..(79): Xaa at position 79 is Gly, Arg, Ala, Cys, Asp, Glu, Phe, His, Lys, Leu, Asn, Gln, Arg, Ser, Thr, Trp or Tyr
  misc_feature (80)..(80): Xaa at position 80 is Arg, Glu, Gln, Lys, Asp, Ala, Cys, Phe, Gly, His, Ile, Leu, Ser, Thr, Val, Tyr or Asn
  misc_feature (81)..(81): Xaa at position 81 is Leu, Pro, Thr, Ile, Val, Ala, Cys, Asp, Phe, Gly, His or Ser
  misc_feature (82)..(82): Xaa at position 82 is Ile, Ala, Leu, Met, Arg and Val
  misc_feature (83)..(83): Xaa at position 83 is Glu, His, Asn, Leu, Gln, Ile, Ala, Cys, Asp, Phe, Gly, Lys, Pro, Arg, Ser, Thr, Tyr or Val
  misc_feature (84)..(84): Xaa at position 84 is Pro, Ala, Cys, Glu, Ile, Ser, Val, Trp or Tyr
  misc_feature (85)..(85): Xaa at position 85 is Leu, Val, Cys, Gly or Ala
  misc_feature (86)..(86): Xaa at position 86 is Ser, Ala, Tyr, Asn, Ile, Val or Thr
MXXXXXXXXSXXXXXXXXXXXXXXXXXXXXXXXXXXXXXXRXDXXXXXXXXXXXXXXXXXYXXXXXXXXXXXXXXXXXXXXXXXXX

SEQ ID NO: 850 - DNA, 261 bp, Artificial Sequence
  Coding sequence for PIP-72 polypeptide
atggcgatcaccgtgacgaacaactcctccaacccgatcgaggtggcgatcaaccactggggcagcgacggcgacaccagcttcttctccgtcggcaacggcaagcaggagacctgggacaggtccgacagccgcggcttcgtgctctccctgaagaagaacggcgctcagcacccgtactacgtccaggccagcagcaagatcgaggtcgacaacaacgccgtgaaggaccagggtcggctgatcgagccgctctcgtga

SEQ ID NO: 851 - DNA, 261 bp, Artificial Sequence
  Coding sequence for PIP-72 polypeptide
atggcgatcacggtgacgaacaactcgagcaaccctatcgaggtcgcgatcaaccactggggctctgacggggacacgagcttcttcagcgtcgggaacgggaagcaggagacgtgggaccgcagcgactcgcgcggcttcgtcctgtcgctcaagaagaacggtgcccagcacccgtactacgtgcaggcgtcgtcgaagatcgaggtcgacaacaacgcggtcaaggaccagggcaggctcatcgagccgctgtcctga

SEQ ID NO: 852 - protein, 86 aa, Artificial Sequence
  PIP-72 polypeptide
MAITVTNNSSNPIEVAINHWGSDGDTSFFSVGNGKQETWDRSDSRGFVLSLKKNGAQHPYYVQASSKIEVDNNAVKDQGRLIEPLS

SEQ ID NO: 853 - DNA, 258 bp, Artificial Sequence
  PIP-72Aa coding sequence with maize optimized codons
atgggtatcacggtcaccaacaacagcagcaaccctatcgaagtggcgatcaaccactggggcagcgacggcgacaccagcttcttcagcgtcggcaacggcaagcaggaaacgtgggacaggtccgactcacgcggcttcgtgctgtccctgaagaagaacggcgcgcagcatccgtactacgtgcaggcgtcgtcgaagatcgaggtggacaacaacgcggtcaaggaccagggtaggctgattgagccgctgtct

SEQ ID NO: 854 - DNA, 258 bp, Artificial Sequence
  PIP-72Aa coding sequence with maize optimized codons
atggggatcacagtcaccaacaacagcagcaacccaatcgaggtcgcgatcaaccactggggaagcgacggagacacctcgttcttcagcgtcggcaacggcaagcaggagacttgggacaggtcagactccagaggcttcgtactgtccctgaagaagaacggcgctcagcatccgtactacgtgcaagcctcgtcgaagatcgaggtggacaacaacgcggtcaaggatcagggtaggctgatcgagccactgtct

SEQ ID NO: 855 - DNA, 258 bp, Artificial Sequence
  PIP-72Aa coding sequence with maize optimized codons
atgggaatcactgtcaccaacaactcgtccaaccctatcgaggtcgcgatcaaccactggggttccgatggggacacgtccttcttcagcgtcggcaatggcaagcaggagacgtgggacaggtccgactccagaggcttcgtgctctcgctgaagaagaacggcgctcagcacccttactacgtgcaggcctcgtcgaagatcgaggtggacaacaacgcggttaaggatcagggtaggctgattgagcctctgtct

SEQ ID NO: 856 - DNA, 258 bp, Artificial Sequence
  PIP-72Aa coding sequence with maize optimized codons
atgggaatcacagtcaccaacaacagcagcaacccgatcgaggtcgcgatcaaccactggggtagcgacggcgacaccagcttcttctccgtgggcaacggcaaacaggagacgtgggacaggtcagacagccgcggcttcgtgctgtccctcaagaagaacggcgcccagcacccatactacgtgcaagcctcgtcgaagatcgaggtggacaacaacgcggtgaaggaccagggtagactgattgagccgctgagc

SEQ ID NO: 857 - DNA, 258 bp, Artificial Sequence
  PIP-72Aa coding sequence with maize optimized codons
atgggtatcacagtcaccaacaactcctcaaacccgatcgaggtggcgatcaaccactggggcagcgacggcgatacctcattcttcagcgttgggaacggcaagcaggagacgtgggatcggtctgacagcagagggtttgttctgtcgctgaagaagaacggcgctcagcacccatactacgtccaagcctcctcgaagatcgaggttgacaacaacgccgttaaggatcagggcagactgattgagccactgtcc

SEQ ID NO: 858 - DNA, 258 bp, Artificial Sequence
  PIP-72Aa coding sequence with maize optimized codons
atgggaataacagtcaccaacaacagcagcaacccgatcgaagtggcgatcaaccactggggtagcgacggcgacacctccttcttcagcgtcggcaacggcaagcaggagacgtgggacaggtccgactctcgcggattcgtcctgtcgctcaagaagaacggtgcccagcacccctactacgtgcaggcctcgtcgaagatcgaggtggacaacaacgcggtcaaggaccaagggaggctgatcgagccgctgtcg

SEQ ID NO: 859 - DNA, 258 bp, Artificial Sequence
  PIP-72Aa coding sequence with maize optimized codons
atggggatcacggtgacgaacaactcctccaatccgatcgaggtggcgatcaaccactggggatcagacggtgacacgagcttcttcagcgttggcaacgggaagcaggagacgtgggacaggtctgacagcagaggttttgtgctgtcgctcaagaagaacggcgctcaacacccatactacgtccaagcctcctctaagatcgaggtggacaacaacgctgtgaaggatcagggcagactcatcgagccactgtcg

SEQ ID NO: 860 - DNA, 258 bp, Artificial Sequence
  PIP-72Aa coding sequence with maize optimized codons
atgggaatcaccgtcaccaacaacagcagcaaccctatcgaagtcgctatcaaccactggggaagcgacggcgacacctccttcttcagcgtcggcaatggcaagcaggagacgtgggacaggtccgactccagaggattcgtgctgtccctgaagaagaacggcgctcagcacccatactacgtgcaagcttcgtcgaagatcgaggtggacaacaacgcggtcaaggatcaagggaggctgatcgagccgctgtcc

SEQ ID NO: 861 - DNA, 258 bp, Artificial Sequence
  PIP-72Aa coding sequence with maize optimized codons
atgggtatcacggtgaccaacaactcctccaacccgatcgaggtggcgatcaaccactggggctcggacggcgacacgagcttcttcagcgtcggcaacgggaagcaggagacgtgggaccgctctgacagcagaggtttcgtgctgtcgctcaagaagaacggcgctcaacacccgtactacgtccaagcctcctccaagatcgaggtcgacaacaacgccgtgaaggaccaaggcagactcatcgagccgctgtcg

SEQ ID NO: 862 - DNA, 258 bp, Artificial Sequence
  PIP-72Aa coding sequence with maize optimized codons
atgggtataaccgtgacgaacaactcctcaaatccgatcgaggtcgcgatcaaccactgggggtcagacggtgacacgagcttcttctccgtgggcaacggtaagcaggagacctgggataggtcggactcaaggggctttgtgctgagcctcaagaagaacggtgctcagcacccgtactacgtccaagcgagctccaagatcgaggtggacaacaacgctgtcaaggaccaaggtaggctgatcgaaccgctgagc

SEQ ID NO: 863 - DNA, 258 bp, Artificial Sequence
  PIP-72Aa coding sequence with maize optimized codons
atggggatcacagtcaccaacaacagcagcaacccgatcgaagtcgcgatcaaccactggggaagcgacggcgacacctcgttcttcagcgtcggcaacggcaagcaggagacgtgggataggtccgactcacgcggcttcgtgctgtccctgaagaagaacggcgcccagcatccgtactacgtgcaagcctcgtcgaagatcgaggtggacaacaacgcggtgaaggaccagggtagactgatcgagccactgtcc

SEQ ID NO: 864 - DNA, 258 bp, Artificial Sequence
  PIP-72Aa coding sequence with maize optimized codons
atgggtatcacggtgacgaacaactcctccaatcctatcgaggtcgcgatcaaccactgggggtcagacggtgacacgagcttcttctccgtgggcaacggcaagcaggagacctgggacaggtcggactcaaggggcttcgtcctgagcctcaagaagaacggcgctcagcacccgtactacgtccaagcgagctccaagatcgaggtggacaacaacgccgtcaaggaccagggtaggctgatcgaaccgctgagc

SEQ ID NO: 865 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
tatcgaaggtaggcatatgnnkattaccgttacaaacaattc

SEQ ID NO: 866 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
cgaaggtaggcatatgggtnnkaccgttacaaacaattcgtc

SEQ ID NO: 867 - DNA, 42 bp, Artificial Sequence
  mutagenesis primer
  misc_feature (22)..(22): n = g, a, t or c
  misc_feature (23)..(23): n = g, a, t or c
  misc_feature (24)..(24): k = g or t
gaaggtaggcatatgggtattnnkgttacaaacaattcgtcc

SEQ ID NO: 868 - DNA, 41 bp, Artificial Sequence
  mutagenesis primer
  misc_feature (21)..(21): n = g, a, t or c
  misc_feature (22)..(22): n = g, a, t or c
  misc_feature (23)..(23): k = g or t
gtaggcatatgggtattaccnnkacaaacaattcgtccaac

SEQ ID NO: 869 - DNA, 44 bp, Artificial Sequence
  mutagenesis primer
  misc_feature (21)..(21): n = g, a, t or c
  misc_feature (22)..(22): n = g, a, t or c
  misc_feature (23)..(23): k = g or t
ggcatatgggtattaccgttnnkaacaattcgtccaaccccatc

SEQ ID NO: 870 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or t
caaacaattcgtccaaccccnnkgaagtcgccatcaatcattg

SEQ ID NO: 871 - DNA, 42 bp, Artificial Sequence
  mutagenesis primer
  misc_feature (22)..(22): n = g, a, t or c
  misc_feature (23)..(23): n = g, a, t or c
  misc_feature (24)..(24): k = g or t
aacaattcgtccaaccccatcnnkgtcgccatcaatcattgg

SEQ ID NO: 872 - DNA, 41 bp, Artificial Sequence
  PIP-72 variant polypeptide
  misc_feature (21)..(21): n = g, a, t or c
  misc_feature (22)..(22): n = g, a, t or c
  misc_feature (23)..(23): k = g or t
ccaaccccatcgaagtcgccnnkaatcattggggtagcgac

SEQ ID NO: 873 - DNA, 41 bp, Artificial Sequence
  mutagenesis primer
  misc_feature (18)..(18): n = g, a, t or c
  misc_feature (19)..(19): n = g, a, t or c
  misc_feature (20)..(20): k = g or t
ccatcgaagtcgccatcnnkcattggggtagcgacggagac

SEQ ID NO: 874 - DNA, 42 bp, Artificial Sequence
  mutagenesis primer
  misc_feature (19)..(19): n = g, a, t or c
  misc_feature (20)..(20): n = g, a, t or c
  misc_feature (21)..(21): k = g or t
gtcgccatcaatcattggnnkagcgacggagacaccagcttc

SEQ ID NO: 875 - DNA, 42 bp, Artificial Sequence
  mutagenesis primer
  misc_feature (22)..(22): n = g, a, t or c
  misc_feature (23)..(23): n = g, a, t or c
  misc_feature (24)..(24): k = g or t
gtcgccatcaatcattggggtnnkgacggagacaccagcttc

SEQ ID NO: 876 - DNA, 45 bp, Artificial Sequence
  mutagenesis primer
  misc_feature (23)..(23): n = g, a, t or c
  misc_feature (24)..(24): n = g, a, t or c
  misc_feature (25)..(25): k = g or t
caatcattggggtagcgacggannkaccagcttcttttccgtcgg

SEQ ID NO: 877 - DNA, 45 bp, Artificial Sequence
  mutagenesis primer
  misc_feature (22)..(22): n = g, a, t or c
  misc_feature (23)..(23): n = g, a, t or c
  misc_feature (24)..(24): k = g or t
cattggggtagcgacggagacnnkagcttcttttccgtcggtaac

SEQ ID NO: 878 - DNA, 44 bp, Artificial Sequence
  mutagenesis primer
  misc_feature (21)..(21): n = g, a, t or c
  misc_feature (22)..(22): n = g, a, t or c
  misc_feature (23)..(23): k = g or t
tttccgtcggtaacggcaagnnkgaaacctgggacaggtccgac

SEQ ID NO: 879 - DNA, 43 bp, Artificial Sequence
  mutagenesis primer
  misc_feature (20)..(20): n = g, a, t or c
  misc_feature (21)..(21): n = g, a, t or c
  misc_feature (22)..(22): k = g or t
cgtgctttccctgaagaagnnkggcgcgcaacacccttactac

SEQ ID NO: 880 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k g or t
tgctttccctgaagaagaatnnkgcgcaacacccttactacgt

SEQ ID NO: 881 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
cctgaagaagaatggcgcgnnkcacccttactacgttcaggc

SEQ ID NO: 882 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
gaagaatggcgcgcaacacnnktactacgttcaggccagcag

SEQ ID NO: 883 - DNA, 41 bp, Artificial Sequence
  mutagenesis primer
  misc_feature (20)..(20): n = g, a, t or c
  misc_feature (21)..(21): n = g, a, t or c
  misc_feature (22)..(22): k = g or t
cgcgcaacacccttactacnnkcaggccagcagcaaaattg

SEQ ID NO: 884 - DNA, 42 bp, Artificial Sequence
  mutagenesis primer
  misc_feature (21)..(21): n = g, a, t or c
  misc_feature (22)..(22): n = g, a, t or c
  misc_feature (23)..(23): k = g or t
cgcaacacccttactacgttnnkgccagcagcaaaattgaag

SEQ ID NO: 885 - DNA, 43 bp, Artificial Sequence
  mutagenesis primer
  misc_feature (22)..(22): n = g, a, t or c
  misc_feature (23)..(23): n = g, a, t or c
  misc_feature (24)..(24): k = g or t
caacacccttactacgttcagnnkagcagcaaaattgaagtcg

SEQ ID NO: 886 - DNA, 42 bp, Artificial Sequence
  mutagenesis primer
  misc_feature (22)..(22): n = g, a, t or c
  misc_feature (23)..(23): n = g, a, t or c
  misc_feature (24)..(24): k = g or t
gttcaggccagcagcaaaattnnkgtcgacaacaacgccgtg

SEQ ID NO: 887 - DNA, 42 bp, Artificial Sequence
  mutagenesis primer
  misc_feature (21)..(21): n = g, a, t or c
  misc_feature (22)..(22): n = g, a, t or c
  misc_feature (23)..(23): k = g or t
gcagcaaaattgaagtcgacnnkaacgccgtgaaagatcagg

SEQ ID NO: 888 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
gaaagatcagggccggttgnnkgagccgctctcgtaaggatc

SEQ ID NO: 889 - DNA, 43 bp, Artificial Sequence
  mutagenesis primer
  misc_feature (21)..(21): n = g, a, t or c
  misc_feature (22)..(2): n = g, a, t or c
  misc_feature (22)..(22): n is a, c, g, or t
  misc_feature (23)..(23): k = g or t
gtattaccgttacaaacaatnnktccaaccccatcgaagtcgc

SEQ ID NO: 890 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
gcgacttcgatggggttggamnnattgtttgtaacggtaatac

SEQ ID NO: 891 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or t
gtagcgacggagacaccagcnnkttttccgtcggtaacggcaa

SEQ ID NO: 892 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
ttgccgttaccgacggaaaamnngctggtgtctccgtcgctac

SEQ ID NO: 893 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = a or c
gcgacggagacaccagcttcnnktccgtcggtaacggcaagca

SEQ ID NO: 894 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
tgcttgccgttaccgacggamnngaagctggtgtctccgtcgc

SEQ ID NO: 895 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or c
tcttttccgtcggtaacggcnnkcaggaaacctgggacaggtc

SEQ ID NO: 896 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
gacctgtcccaggtttcctgmnngccgttaccgacggaaaaga

SEQ ID NO: 897 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or t
gtggcttcgtgctttccctgnnkaagaatggcgcgcaacaccc

SEQ ID NO: 898 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
gggtgttgcgcgccattcttmnncagggaaagcacgaagccac

SEQ ID NO: 899 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): m = a or c
actacgttcaggccagcagcnnkattgaagtcgacaacaacgc

SEQ ID NO: 900 - DNA, 43 bp, Artificial Sequence
  mutagenesis primer
  misc_feature (2)..(23): n = g, a, t or c
  misc_feature (21)..(21): m = a or c
  misc_feature (22)..(22): n = g, a, t or c
gcgttgttgtcgacttcaatmnngctgctggcctgaacgtagt

SEQ ID NO: 901 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or t
aagtcgacaacaacgccgtgnnkgatcagggccggttgatcga

SEQ ID NO: 902 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
tcgatcaaccggccctgatcmnncacggcgttgttgtcgactt

SEQ ID NO: 903 - protein, 86 aa, Artificial Sequence
  PIP-72 variant polypeptide
MGITVTNNSENPIEVAINHWGSDGDTSFFSVGNGKQETWDRSDSRGFVMSLKKNGAQHPYYVQASSKIEVDNNAVKDQGRLIYPLS

SEQ ID NO: 904 - protein, 86 aa, Artificial Sequence; identical to SEQ ID NO: 649
  PIP-72 variant polypeptide

SEQ ID NO: 905 - protein, 86 aa, Artificial Sequence
  PIP-72 variant polypeptide
MGITVTNNSENPIEVAINHWGSDGDTSFFGIDSGKQESWDRSDSRGFVLSLKRNGAQAPYYVQASSKIEVDNNAVKDQGRLIEPLS

SEQ ID NO: 906 - protein, 86 aa, Artificial Sequence
  PIP-72 variant polypeptide
MGITVTNNSTNPIEVAINHWGSDGDTSFFGIDSGKQESWDRSDSRGFVLSLKRNGAQAPYYVQASSKIEVDNNAVKDQGRLIEPLS

SEQ ID NO: 907 - protein, 86 aa, Artificial Sequence
  PIP-72 variant polypeptide
MGITVTNNSVNPIEVAINHWGSDGDTSFFGIDSGKQESWDRSDSRGFVLSLKRNGAQAPYYVQASSKIEVDNNAVKDQGRLIEPLS

SEQ ID NO: 908 - protein, 86 aa, Artificial Sequence
  PIP-72 variant polypeptide
MGITVTNNSANPIEVAINHWGSDGDTSFFGIDSGKQESWDRSDSRGFVLSLKRNGAQAPYYVQASSKIEVDNNAVKDQGRLIEPLS

SEQ ID NO: 909 - protein, 86 aa, Artificial Sequence
  PIP-72 variant polypeptide
MGITVTNNSLNPIEVAINHWGSDGDTSFFGIDSGKQESWDRSDSRGFVLSLKRNGAQAPYYVQASSKIEVDNNAVKDQGRLIEPLS

SEQ ID NO: 910 - protein, 86 aa, Artificial Sequence
  PIP-72 variant polypeptide
MGITVTNNSENPIEVAINHWGSDGDTSFFGIDSGKQESWDRSDSRGFVLSLKRNGAQAPYYVQASSKIEVDNNAVKDHGRLIEPLS

SEQ ID NO: 911 - protein, 86 aa, Artificial Sequence
  PIP-72 variant polypeptide
MGITVTNMSSNPIEVAINHWGSDGDTSFFGIDSGKQESWDRSDSRGFVLSLKRNGAQAPYYVQASSKIEVDNNAVKDQGRLIEPLS

SEQ ID NO: 912 - protein, 86 aa, Artificial Sequence
  PIP-72 variant polypeptide
MGITVTNNSSNPIEVAINHWGSDGDTSFFGIDSGKQESWDRSDSRGFVLSLKRNGAQAPYYVQASSKIEVHNNAVKDQGRLIFPLS

SEQ ID NO: 913 - protein, 86 aa, Artificial Sequence
  PIP-72 variant polypeptide
MGISVTNNSSNPIEVAINHWGSDGDTSFFGIDSGKQESWDRSDSRGFVLSLKRQGAQAPYYVQASSKIEVDNNAVKDHGRLIEPLS

SEQ ID NO: 914 - protein, 86 aa, Artificial Sequence
  PIP-72 variant polypeptide
MGITVTNNSSNPIEVAINHWGSDGDTSFFGIDSGKQESWDRSDSRGFVLSLKRNGAQAPYYVQASSKIEVHNNAVKDQGRLIEPLS

SEQ ID NO: 915 - DNA, 258 bp, Artificial Sequence
  PIP-72 variant polypeptide
atgggtattaccgttacaaacaattcggaaaaccccatcgaagtcgccatcaatcattggggtagcgacggagacaccagcttcttttccgtcggtaacggcaagcaggaaacctgggacaggtccgacagccgtggcttcgtgatgtccctgaagaagaatggcgcgcaacacccttactacgttcaggccagcagcaaaattgaagtcgacaacaacgccgtgaaagatcagggccggttgatctatccgctctcg

SEQ ID NO: 916 - DNA, 258 bp, Artificial Sequence
  PIP-72 variant polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 917 - DNA, 258 bp, Artificial Sequence
  PIP-72 variant polypeptide
atgggtattaccgttacaaacaattcggaaaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 918 - DNA, 258 bp, Artificial Sequence
  PIP-72 variant polypeptide
atgggtattaccgttacaaacaattcgacgaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 919 - DNA, 258 bp, Artificial Sequence
  PIP-72 variant polypeptide
atgggtattaccgttacaaacaattcggttaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 920 - DNA, 258 bp, Artificial Sequence
  PIP-72 variant polypeptide
atgggtattaccgttacaaacaattcggctaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 921 - DNA, 258 bp, Artificial Sequence
  PIP-72 variant polypeptide
atgggtattaccgttacaaacaattcgttgaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 922 - DNA, 258 bp, Artificial Sequence
  PIP-72 variant polypeptide
atgggtattaccgttacaaacaattcggaaaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcatggccggttgatcgagccgctctcg

SEQ ID NO: 923 - DNA, 258 bp, Artificial Sequence
  PIP-72 variant polypeptide
atgggtattaccgttacaaacatgtcgtccaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 924 - DNA, 258 bp, Artificial Sequence
  PIP-72 variant polypeptide
atgggtattaccgttacaaacaattcgtccaaccccatcgaggtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtccataacaacgccgtgaaagatcagggccggttgatcttcccgctctcg

SEQ ID NO: 925 - DNA, 258 bp, Artificial Sequence
  PIP-72 variant polypeptide
atgggcattagcgttacaaacaattcgtccaaccccatcgaagtcgccatcaatcattggggtagcgacggagacaccagcttctttggcattgacagcggcaagcaggagtcttgggacaggtccgacagccgtggcttcgtgctttccctgaagcgtcaaggcgcccaagctccttactacgttcaggccagcagcaaaattgaagtcgacaacaacgccgtgaaagatcatggccggttgatcgagccgctctcc

SEQ ID NO: 926 - DNA, 258 bp, Artificial Sequence
  PIP-72 variant polypeptide
atgggtattaccgttacaaacaattcgtccaaccccatcgaggtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtccacaacaacgccgtgaaagatcagggccggttgatcgagccgctctcg

SEQ ID NO: 927 - protein, 86 aa, Pseudomonas chlororaphis
MGITVKNNSSNPIEVAINRWGNDGDTNFFSVGNGKQETWDRSDSRGFVLSLKKNGAQHPYYVQASSKIEVDNNAVKDQGQLIEPLS

SEQ ID NO: 928 - protein, 86 aa, Pseudomonas brassicacearum
MGITVKNNSSNTIEVAVNHWGSDGDTSFFSIANGKQESWDRSDSRGFVLSLKKNGAQHPYYVQASSRIEVDNNAVKDQGQPIQPLS

SEQ ID NO: 929 - protein, 86 aa, Pseudomonas sp. QTF5
MGITVTNNSSHTIEVAINQWGDDGDTSFFSIANGKNESWDRSDDRGFVLSLQKNGAQYPYYVQASSNIKVDNNGVTDQGEAIYPLA

SEQ ID NO: 930 - protein, 86 aa, Halomonas anticariensis
MTIQVTNNAQQEVEVAINEWGTGGDTSFFTLHQGKSEKWDRVDERGFVMAVKHRGAQRPYYVQHQSNINIYDHRVTDHDSIIRTID

SEQ ID NO: 931 - protein, 90 aa, Burkholderia pseudomallei
MAISVKNSASNTVEVSINHWGTDGDTKPFKMAPGASDSWNRTDLRGFVMYVQLGGSATPYYVLSTSNIVIYDDKVTDSGQTLLPANKRFG

SEQ ID NO: 932 - protein, 91 aa, Pseudomonas entomophila
MKLTITNGASTSIDIAVSAWRNDGNDSYYSIAQGESDTWDRSDARGYLMAVKMKSQVKTYYISQASKIVVEDNLVKDHGQTINPLYAVNSM

SEQ ID NO: 933 - protein, 91 aa, Pseudomonas entomophila
MKLTITNGASTSIEIAVSAWRNDGNDSYYSIAQGESDTWDRSDARGYLMAVKMKSQVKTYYISQTSKIVVEDNIVKDHGQTLNPLYAANNM

SEQ ID NO: 934 - protein, 96 aa, Pseudomonas chlororaphis
MSITVTNGASTVVNVAISTWEKDGSDAYWPLEQGKGDTWKRSDPRGYLMAIQDKSQTTEYYVTCNSVIVIEDNLVKDHGRTLNPVAAAGKKNVVNA

SEQ ID NO: 935 - protein, 96 aa, Pseudomonas chlororaphis
MSITVTNGASAVVKVAISTWQKDGNDDFWSLDQGASDTWKRSDTRGYLMAVQDKSRTTEYYVSCNSAIVIEDNLVKDHGRTLNPLIAAGQKNVANA

SEQ ID NO: 936 - protein, 89 aa, Burkholderia multivorans
MAITVTNKSAEDVQVSISTWGNHGDPNPYPVKTGVTESWDRKDPRGFVLYLQKGATAQPYYVQAGAAIVFFSFQEVTDNGEPIHPVSAP

SEQ ID NO: 937 - protein, 90 aa, Burkholderia pseudomallei
MAISVKNSASNTVEVSINHWGTDGDTKPFKMAPGASDSWNRNDLRGFVMYVQLGGSATPYYVLSTSNIVIYDDKVTDSGQTLLPANKRFG

SEQ ID NO: 938 - protein, 92 aa, Burkholderia pseudomallei
MAISVKNSASNTVEVSINNWETDVDTSTKPFKMAPGASDSWNRTDLRGYVIYVQLGGSATPYYVMSTSNIVIYDDKVTDSGQTLLPANKRFG

SEQ ID NO: 939 - protein, 95 aa, Pseudomonas chlororaphis
MSIKITNGATREVQVAVSFWYTDGKAGDVSDTYYPLKPGSGEEWKRNDPRGYLMTIKGQSQAGVYYVAFDSEILIEDNLVKDRGETITRLSLKFE

SEQ ID NO: 940 - protein, 96 aa, Pseudomonas chlororaphis
MSITVTNGASAVVNVAISTWEKDGSDAYYPLEQGSGDTWKRSDPRGYLMAIQDKSQTTEYYVSCNSAIVIEDNLVKDDGRTLNPVAAAGKKKVVNA

SEQ ID NO: 941 - protein, 91 aa, Pseudomonas mosselii
MKLTITNGASTSVDIAVSTWRNDGNDSYYSIAQGESDTWDRSDARGYLMAVKMKSQVKTYYISQTSKIVVEDNLVKDHGQTLNPLYAVNNM

SEQ ID NO: 942 - protein, 76 aa, Burkholderia thailandensis
MSINHWGTDGDTKPFKMAPGASDSWNCTDFRGYVMYVQLGGSATPYYVLSTSNIVIYDDKVTDSGQTLLPANKRFG

SEQ ID NO: 943 - protein, 91 aa, Pseudomonas protegens
MGTISVSNGASGEINVSVSTWQKDGVDTYFTIAPGNFETWTRNDPRGYLMAVNGNTKKNEYYISPTSKIVIEDNLVKDHGQTIYPLILANA

SEQ ID NO: 944 - protein, 91 aa, Pseudomonas plecoglossicida
MKLTITNGASTSIEIAVSAWRNDGNDSYYSIAQGESDTWDRSDARGYLMAVKMKSQVKTYYISQTSKIVVEDNIVKDHGQTLNPLYAVNNM

SEQ ID NO: 945 - protein, 90 aa, Unknown
  unknown
MSITITNGASRTVQIAVSVWGRDGSDDYYALEPGKGDTWGRNDPRGYLMAIKGQTQAGVYYVAFDSQIVIEDNLVKDRGRTINPLASNNQ

SEQ ID NO: 946 - protein, 98 aa, Pseudomonas chlororaphis
MKMSITVTNGASTVVNVAISTWEKDGSDAYYPLQQGSGDTWKRSDPRGYLMAIQDKSQTTEYYVSCNSVIVIEDNVVKDHGRTLNPVAAAGKKKVANA

SEQ ID NO: 947 - protein, 85 aa, Paludibacterium yongneupense
MIKVINKTGLPIKVSINHWGSGGDTSYFTIEKDKAETWDRTDARGFVMATIVKGVGRSQIVFAGTEVVVDEKYLSGSVKTEAVEA

SEQ ID NO: 948 - protein, 76 aa, Burkholderia thailandensis
MSINHWGTDGDTNPFKMAPGASDSWNRTDLRGYVMYVQLGGSATPYYVLSTSNIVIYDDKVTDSGQTLLPANQRFG

SEQ ID NO: 949 - DNA, 258 bp, Pseudomonas chlororaphis
atgggtattaccgttaaaaacaattcgtccaaccccatcgaagttgccatcaatcgttggggtaacgacggagacaccaacttcttttccgtcggtaacggcaaacaggaaacctgggacaggtccgacagccgtggcttcgtgctttccctgaagaagaatggcgcgcaacacccgtactacgttcaggccagcagcaaaattgaagtcgacaacaacgccgtgaaagatcagggccagttgatcgagccgctctcg

SEQ ID NO: 950 - DNA, 258 bp, Pseudomonas brassicacearum
atgggcattactgttaaaaataactcatccaacaccattgaagttgcggtcaatcattggggcagcgacggagataccagcttcttttcaatcgctaacggcaagcaggaaagctgggacaggtccgacagccgcggttttgtactctccttgaagaaaaatggagcacaacatccgtactacgttcaggccagtagcagaattgaagtcgacaataatgcagtgaaggatcagggccagcctattcaacccctctcc

SEQ ID NO: 951 - DNA, 258 bp, Pseudomonas sp. QTF5
atgggcattaccgttacaaataactcatcacacactattgaagttgcaatcaatcagtggggagatgacggggatacgagttttttttcaatagctaacggcaaaaacgaaagctgggatcggtctgacgatcgcggctttgttctctctttacaaaaaaatggagcacaatatccgtattacgttcaggccagtagcaatattaaagttgacaataacggagtaacggatcagggcgaggctatttatcctctagcc

SEQ ID NO: 952 - DNA, 258 bp, Halomonas anticariensis
atgactatccaagtcacaaataacgcccaacaagaggttgaagttgccatcaatgagtggggtaccggcggcgataccagctttttcacattacatcaaggcaagtccgagaaatgggatcgcgtcgatgaacgcggctttgtgatggcagtgaaacataggggggcgcaacgcccatattacgtccagcatcaaagcaacattaacatctatgaccatagagttaccgatcacgactcgattattcgtacgatagac

SEQ ID NO: 953 - DNA, 270 bp, Burkholderia pseudomallei
atggcgataagcgtcaaaaacagcgcatcgaacacggttgaagtgtcgatcaatcactggggaacggacggagacaccaagccgttcaagatggcgcccggagccagcgattcctggaatcgcaccgacctacgtggcttcgtcatgtatgtgcagctgggcgggtcggcgacgccgtactatgtgctgagcaccagcaatatcgtgatctacgacgacaaggtgacggatagcgggcaaacgctccttcccgcaaacaagcgttttggc

SEQ ID NO: 954 - DNA, 273 bp, Pseudomonas entomophila
atgaagctcacgatcaccaatggcgcaagcacatcgattgatattgcagtgagtgcatggcgtaacgacggcaatgacagttactactcgatagctcaaggagagtctgatacctgggaccgcagcgacgccagagggtacttgatggcggtaaaaatgaaatcccaagtaaaaacctactatatttctcaagccagcaagatcgttgttgaagacaaccttgtgaaagaccacggtcaaactattaatccgctgtacgcagtaaatagcatg

SEQ ID NO: 955 - DNA, 273 bp, Pseudomonas entomophila
atgaagctcacgatcaccaatggcgcaagcacatcgattgaaattgcagtgagtgcatggcgtaacgacggcaatgacagttactactcgatagctcaaggggaatctgatacctgggaccgcagcgacgcaagagggtacttgatggcggtaaaaatgaaatcccaggtaaaaacctactacatatcccaaaccagcaagatagttgttgaagacaacattgttaaagaccacggccaaacccttaacccgctatacgcagcaaacaacatg

SEQ ID NO: 956 - DNA, 291 bp, Pseudomonas chlororaphis
atgagcatcacagtcaccaacggggcaagcacagtagttaacgtggcaatcagtacatgggagaaagacggcagtgacgcttactggccattagagcaaggcaaaggtgatacctggaaacgtagtgacccaaggggttacttgatggccatacaggataaatcccaaacaactgaatactacgtcacctgcaacagtgtaattgtcatcgaagacaacctcgtgaaggatcacggccggactcttaacccagtcgccgcggccgggaagaaaaatgtggtaaatgcgtaa

SEQ ID NO: 957 - DNA, 288 bp, Pseudomonas chlororaphis
atgagcatcacagtcacaaacggtgcaagcgcagtagttaaagtagccattagcacatggcagaaagacggcaatgacgatttctggtcattagatcaaggcgcaagcgatacctggaaacgtagcgacacaaggggctacttgatggccgtgcaagacaagtcccgcacaactgaatactacgtttcctgcaacagcgccatcgttatcgaagacaacctcgtcaaagatcacggtcgaactcttaacccactcattgcggccgggcagaagaacgtggcgaatgcg

SEQ ID NO: 958 - DNA, 267 bp, Burkholderia multivorans
atggcaattactgtgacgaacaaatcggcagaagatgtccaggtgtccatcagcacctggggcaatcacggcgacccgaatccgtacccggtcaagaccggggtcacggaaagctgggaccgcaaggacccgcgcggcttcgtgctgtacctgcagaaaggggcgacggcgcagccgtactacgtacaggccggcgcagcaatcgtgttcttctccttccaggaggtcacggacaacggcgagccgatccacccggtgagtgcgccg

SEQ ID NO: 959 - DNA, 270 bp, Burkholderia pseudomallei
atggcgataagcgtcaaaaacagcgcatcgaacacggttgaagtgtcgatcaatcactggggaacggacggagacaccaagccgttcaagatggcgcccggagccagcgattcctggaatcgcaacgacctacgtggcttcgtcatgtatgtgcagttgggcgggtcggcgacgccgtactatgtgctgagcaccagtaatatcgtgatctacgacgacaaggtgacggatagcgggcaaacgctccttcccgcaaacaagcgttttggc

SEQ ID NO: 960 - DNA, 276 bp, Burkholderia pseudomallei
atggcgataagcgtcaaaaacagcgcatcgaacacggttgaagtgtcgatcaataactgggaaacggacgtagacaccagcaccaagccgttcaagatggcgcccggagccagcgattcctggaatcgcaccgacctacgtggctacgtcatctatgtgcagctgggcgggtcggcgacgccgtactatgtgatgagcaccagcaatatcgtgatctacgacgacaaggtgacggatagcgggcaaacgctccttcccgcaaacaagcgttttggc

SEQ ID NO: 961 - DNA, 285 bp, Pseudomonas chlororaphis
atgagcatcaaaatcacaaacggggccaccagagaggtccaagtcgcagtcagcttttggtatacagatggtaaagccggtgacgtcagtgatacctattacccactgaagcccggcagtggtgaagaatggaaacgcaatgacccaagaggttacttgatgaccataaaaggccaatcccaagcaggtgtatattacgttgcctttgacagcgaaatcctcatagaagacaaccttgtaaaggaccgcggcgaaaccattacccgactatctttgaagtttgaa

SEQ ID NO: 962 - DNA, 288 bp, Pseudomonas chlororaphis
atgagcatcacagtcacaaacggagcaagcgcagtagttaacgtggcaatcagcacatgggagaaagacggcagtgacgcttactacccattagagcaaggcagcggtgacacctggaaacgtagtgacccaaggggttacttgatggccatacaggataaatcccaaacaactgaatactacgtctcctgcaacagtgcaattgtcatcgaagacaacctcgtaaaggatgacggccgaactcttaacccagtcgctgcggccgggaagaaaaaagtggtaaatgcg

SEQ ID NO: 963 - DNA, 273 bp, Pseudomonas mosselii
atgaagctcacgatcaccaatggcgcaagcacctcagttgacattgcagtgagtacatggcgtaacgacggcaatgacagctactactcaatagctcaaggggaatctgatacctgggaccgcagcgacgcaagagggtacttgatggcggtaaaaatgaaatcccaggtaaaaacctactacatctcccaaaccagcaagatcgttgttgaagacaaccttgtgaaagaccacggtcaaacgcttaatccgctatatgcagtgaataacatg

SEQ ID NO: 964 - DNA, 228 bp, Burkholderia thailandensis
gtgtcgatcaatcactggggaacggacggcgacaccaagccgttcaagatggcgcccggagccagcgattcctggaattgcaccgactttcgcggctacgtcatgtatgtgcagctgggcgggtcggcgacgccgtactatgtgctgagcaccagcaatatcgtgatctacgacgacaaggtgacggatagcgggcaaacgctccttcccgcaaacaagcgttttggc

SEQ ID NO: 965 - DNA, 273 bp, Pseudomonas protegens
atgggtacaatctcggtctcaaacggtgcaagcggggaaattaatgtttcagttagcacatggcaaaaagacggtgttgacacttatttcacaatagccccgggcaactttgaaacttggacgcgcaacgatccaagaggctatttaatggccgtaaatggcaacaccaagaaaaacgaatactacatctcccccaccagcaaaatagttatcgaggacaaccttgtaaaggaccacggccaaactatttacccattaattctagctaacgcg

SEQ ID NO: 966 - DNA, 276 bp, Pseudomonas plecoglossicida
atgaagctcacgatcaccaatggcgcaagcacctcagttgacattgcagtgagtacatggcgtaacgacggtaatgacagctactactcaatagctcaaggggaatctgatacttgggaccgcagcgacgcaagagggtacttgatggcggtaaaaatgaaatcccaagtaaaaacctactacatctcccaaaccagtaagatcgttgttgaagacaacattgtaaaagaccacggccaaacgcttaatccgctatacgcattaaataacatgtag

SEQ ID NO: 967 - DNA, 270 bp, Unknown
  unknown
atgagcatcacaatcacaaacggagcaagcagaacggtccaaattgcagtcagcgtatgggggcgagacggcagtgacgattattatgcactggagcccggcaaaggtgatacatgggggcgtaatgacccaagaggttacttgatggccataaaaggccagacccaagcaggtgtatattacgttgcctttgacagtcaaatcgtcatagaagacaaccttgtaaaggatcgcggccgaactatcaacccactcgcttcgaacaatcaa

SEQ ID NO: 968 - DNA, 288 bp, Pseudomonas chlororaphis
atgagcatcacagtcacaaacggggcaagcacagtagttaacgtggcaatcagtacatgggagaaagacggcagtgacgcttactacccattacagcaaggcagcggtgacacctggaaacgtagtgacccaaggggttacttgatggccattcaggataaatcccaaacaactgaatactacgtctcctgcaacagtgtaattgtcatcgaagacaacgtcgtgaaggatcacggccggactcttaacccagtcgctgcggccgggaagaaaaaagtggcaaatgcg

SEQ ID NO: 969 - DNA, 255 bp, Paludibacterium yongneupense
atgatcaaagttatcaataaaaccggtcttccgatcaaggtttcgatcaaccactggggaagcggcggcgatacgagctacttcacgatagaaaaagacaaggctgaaacgtgggaccgcactgacgcccgtggcttcgtgatggcaacgatcgtcaagggcgtcggtcgctcacaaatcgtgttcgcaggcacggaggtcgtcgttgatgaaaaatatctctcaggctcggttaaaaccgaggcagtagaagca

SEQ ID NO: 970 - DNA, 228 bp, Burkholderia thailandensis
gtgtcgatcaatcactggggaacggacggagacaccaatccgttcaagatggcgcccggagccagcgattcctggaatcgcaccgaccttcgcggctacgtcatgtatgtgcagttgggcgggtcggcgacgccgtactatgtgctgagtaccagcaatatcgtgatctacgacgacaaggtgacggatagcgggcaaacgctccttcccgcaaaccagcgttttggc

SEQ ID NO: 971 - DNA, 38 bp, Artificial Sequence
  Cloning Primer
atgatcatatgggtattaccgttaaaaacaattcgtcc

SEQ ID NO: 972 - DNA, 38 bp, Artificial Sequence
  Cloning Primer
atggatccttacgagagcggctcgatcaactggccctg

SEQ ID NO: 973 - DNA, 38 bp, Artificial Sequence
  Cloning Primer
atgatcatatgggcattactgttaaaaataactcatcc

SEQ ID NO: 974 - DNA, 35 bp, Artificial Sequence
  Cloning Primer
atggatccttaggagaggggttgaataggctggcc

SEQ ID NO: 975 - DNA, 34 bp, Artificial Sequence
  Cloning Primer
atgatcatatgaagctcacgatcaccaatggcgc

SEQ ID NO: 976 - DNA, 35 bp, Artificial Sequence
  Cloning Primer
atggatccttacatgttgtttgctgcgtatagcgg

SEQ ID NO: 977 - DNA, 37 bp, Artificial Sequence
  Cloning Primer
atgatcatatgagcatcacagtcacaaacggagcaag

SEQ ID NO: 978 - DNA, 36 bp, Artificial Sequence
  Cloning Primer
atggatccttacgcatttaccacttttttcttcccg

SEQ ID NO: 979 - DNA, 37 bp, Artificial Sequence
  Cloning Primer
atgatcatatgagcatcaaaatcacaaacggggccac

SEQ ID NO: 980 - DNA, 39 bp, Artificial Sequence
  Cloning Primer
atggatccttattcaaacttcaaagatagtcgggtaatg

SEQ ID NO: 981 - DNA, 1327 bp, Diabrotica virgifera
  misc_feature (1)..(1327): RNAi target sequence DV-RYANR-FIS
ggggataataagttcgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgctggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaataactttcatcgtaatataaatatatttatttaggttatatactttactttaagcagctcaagtataccgtgacatcccactcatacatcaatgtctataattgtttcatgacaaatcatttaatagtattttaaagcattcattcgttcaacaccttttttacatttttcaagtattatatcaatctttttaaagaattgtttggctattaaccggattcaatccatatagttccgtaaaataattatgcgttttaataattaatgtaattaaaaatagttagtatatttttgaaataaaacaactgccgcaacaaattagggagaatacttttgtctcctgtagttttatctgttatccaaagttcgattaaattgtttcaatttaatgtatttttccatataacgcaccaaatagtcttaaaaaaatagtgcctgttactacctaatactttctacgtatgccttatggttagtagtggctccaataggtgcattttacatttttcatgaaaattcaattcacattattttcctcccgttctcttcatattatatttatttattctttaatatagttttgggcgtgaagcccagtaaatacctatatgaagtatattgatggaactgccatgcttgatgggttttgtctgcaattaaaataaaaccaaaacaaacatttgtacagtattgtaaaattcacaatatttaggtagatgtttaaaatttaatattttttaagagtttgcatttatgttaatcgtagttaagtttttataaaaatttagtagttgtgagaaataaaataagtaaaagagaaa

SEQ ID NO: 982 - DNA, 193 bp, Diabrotica virgifera
  misc_feature (1)..(193): RNAi target sequence DV-RYANR-FRAG1
tttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtag

SEQ ID NO: 983 - DNA, 145 bp, Diabrotica virgifera
  misc_feature (1)..(145): RNAi target sequence DV-RYANR-FRAG2
acgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaag

SEQ ID NO: 984 - DNA, 83 bp, Diabrotica virgifera
  misc_feature (1)..(83): RNAi target sequence DV-RYANR-FRAG3
accattgtcctgaaattgctgaagttggtgatcaatttgatatgtctcatcttgtaccgaaccggatatcaaggctacttctt

SEQ ID NO: 985 - DNA, 292 bp, Diabrotica virgifera
  misc_feature (1)..(292): RNAi target sequence DV-RYANR-FRAG4
atttatgatttacacattcgtctcgctgatcagcctttgcttcgctagtggagatcacaaaacgacattcactgatattctgatgaatatagtagggatttttatgtggatagctgctggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaa

SEQ ID NO: 986 - DNA, 502 bp, Diabrotica virgifera
  misc_feature (1)..(502): RNAi target sequence DV-RYANR-FRAG5
ataataagttcgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgctggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaa

SEQ ID NO: 987 - DNA, 199 bp, Diabrotica virgifera
  misc_feature (1)..(199): RNAi target sequence DV-RYANR-FRAG6
gcagctcaagtataccgtgacatcccactcatacatcaatgtctataattgtttcatgacaaatcatttaatagtattttaaagcattcattcgttcaacaccttttttacatttttcaagtattatatcaatctttttaaagaattgtttggctattaaccggattcaatccatatagttccgtaaaataattatgcg

SEQ ID NO: 988 - DNA, 197 bp, Diabrotica virgifera
  misc_feature (1)..(197): RNAi target sequence DV-RYANR-FRAG7
ctgccgcaacaaattagggagaatacttttgtctcctgtagttttatctgttatccaaagttcgattaaattgtttcaatttaatgtatttttccatataacgcaccaaatagtcttaaaaaaatagtgcctgttactacctaatactttctacgtatgccttatggttagtagtggctccaataggtgcattttac

SEQ ID NO: 989 - DNA, 142 bp, Diabrotica virgifera
  misc_feature (1)..(142): RNAi target sequence DV-RYANR-FRAG8
gatttatgatttacacattcgtctcgctgatcagcctttgcttcgctagtggagatcacaaaacgacattcactgatattctgatgaatatagtagggatttttatgtggatagctgctggagctacagctcttcattattg

SEQ ID NO: 990 - DNA, 129 bp, Diabrotica virgifera
  misc_feature (1)..(129): RNAi target sequence DV-RYANR-FRAG9
cacattcgtctcgctgatcagcctttgcttcgctagtggagatcacaaaacgacattcactgatattctgatgaatatagtagggatttttatgtggatagctgctggagctacagctcttcattattg

SEQ ID NO: 991 - DNA, 152 bp, Diabrotica virgifera
  misc_feature (1)..(152): RNAi target sequence DV-RYANR-FRAG10
ggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaa

SEQ ID NO: 992 - DNA, 1432 bp, Diabrotica virgifera
  misc_feature (1)..(1432): RNAi target sequence ta00611.03_diavv
cagaatcttatctgtaaagataaactaattatctctattgactcacctcattttatacgtagcaggtgaaaatacaccattgtagtgaaaattattattagttcgatttataataagttcgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgttggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaataactttcatcgtaatataaatatatttatttaggttatatactttactttaagcagctcaagtataccgtgacatcccactcatacatcaatgtctataattgtttcatgacaaatcatttaatagtattttaaagcattcattcgttcaacaccttttttacatttttcaagtattatatcaatctttttaaagaattgtttggctattaaccggattcaatccatatagttccgtaaaataattatgcgttttaataattaatgtaattaaaaatagttagtatatttttgaaataaaacaactgccgcaacaaattagggagaatacttttgtctcctgtagttttatctgttatccaaagttcgattaaattgtttcaatttaatgtatttttccatataacgcaccaaatagtcttaaaaaaatagtgcctgttactacctaatactttctacgtatgccttatggttagtagtggctccaataggtgcattttacatttttcatgaaaattcaattcacattattttcctcccgttctcttcatattatatttatttattctttaatatagttttgggcgtgaagcccagtaaatacctatatgaagtatattgatggaactgccatgcttgatgggttttgtctgcaattaaaataaaaccaaaacaaacatttgtacagtattgtaaaattcacaatatttaggtagatgtttaaaatttaatattttttaagagtttgcatttatgttaatcgtagttaagtttttataaaaatttagtagttgtgagaaataaaataagtaaaagagaat

SEQ ID NO: 993 - DNA, 211 bp, Diabrotica virgifera
gataataagttcgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtagg

SEQ ID NO: 994 - DNA, 593 bp, Diabrotica virgifera
  misc_feature (1)..(225): RNAi target sequence DV-HP2-FIS
  misc_feature (480)..(480): n can be any nucleotide
  misc_feature (495)..(495): n can be any nucleotide
tgacttcacacttccagatggttctagagcagcaatagtgaataacataaatgacatggaaagggtttacaatgattttggttccaaatggatgttggaggatgtgttagatcctcaaaagggtagagcattgttccacagggaattcggaaggacttcagcgacttacaacaacaaaacgttcaagcctcaattcctaatgaatccggaagatttcctaccaaccaacagatctacagatcttaagcgaatatccgaaatatgtcctctaaagttgtacgaatgttactacgattacgctatgacggttgacagggatttggcgcattacaccaagaattataaagccacgatctatcaatataaagaaacgacaaggaggaaagttgtgtcttgcggagtactagaaacaccgagattcggacgaaagagtactttcctgttcgtgcccggtacgaaggttacctatgaatgcatccnagagttcgtgttggntaggtgatcagcggagagagtgtcaagcggatggaacatggaatattcctgaatacggatacacatattgcttacgtcagcaggaatactctcaacga

SEQ ID NO: 995 - DNA, 600 bp, Diabrotica virgifera
ggggctttctgatttttgacagcttctatagaagtttatcaagatgttgatgccaaaaaagaatagagtatgtatttacgaatacctcttcaaagagggagtcatggtagctaaaaaagattaccatgccccaaaacacctcgaactagaaactatccctaaccttcaagtaattaaggctttacaatcacttaaatcaaaaggttacgtaaaggaacaattcgcctggaggcattattattggtatttgactaactctggcatcgaatacctccgcacattcttacacttacctggagaaattgtcccatctaccttgaaacgcccagcaaggacagaaaccacccgtcctagaccagctgctctcagatctgagacatctaaaccttcagaagaccgtgcaggatacagaaggactcctggaggccctggagctgacaagaaagctgatgttggtccaggaactggagatgttgagttcaggcaaggattcggacgtggacgggcaccacaataaatttattgataagttaatttttataaattgatcagccaataaaaagtttggttaaaaaaaaaaaaaaaaaaaaaaaaaaaaaa

That which is claimed:

1. A DNA construct comprising i) a nucleic acid molecule encoding a polypeptide having at least 95% sequence identity to SEQ ID NO: 2, wherein the polypeptide has insecticidal activity and ii) a silencing element targeting a sequence having at least 95% sequence identity to SEQ ID NO: 993, wherein the silencing element has insecticidal activity.

2. The DNA construct of claim 1, wherein the nucleic acid molecule is operably linked to a heterologous regulatory element.

3. The DNA construct of claim 1, wherein the silencing element comprises a double stranded RNA.

4. A molecular stack comprising i) a nucleic acid molecule encoding a polypeptide having at least 95% sequence identity to SEQ ID NO: 2, wherein the polypeptide has insecticidal activity and ii) a silencing element targeting a sequence having at least 95% sequence identity to SEQ ID NO: 993, wherein the silencing element has insecticidal activity.

5. The molecular stack of claim 4, wherein the nucleic acid molecule is operably linked to a heterologous regulatory element.

6. The molecular stack of claim 4, wherein the silencing element is a sense suppression element, an antisense suppression element, a double stranded RNA, a siRNA, an amiRNA, a miRNA, or a hairpin suppression element.

7. A breeding stack comprising i) a nucleic acid molecule encoding a polypeptide having at least 95% sequence identity to SEQ ID NO: 2, wherein the polypeptide has insecticidal activity and ii) a sequence having at least 95% sequence identity to SEQ ID NO: 993, wherein the silencing element has insecticidal activity.

8. The breeding stack of claim 7, wherein the nucleic acid molecule is each operably linked to a heterologous regulatory element.

9. The breeding stack of claim 7, wherein the silencing element comprises a double stranded RNA.

10. A transgenic plant comprising the DNA construct of claim 1.

11. A transgenic plant comprising the molecular stack of claim 4.

12. A transgenic plant comprising the breeding stack of claim 7.

13. A composition comprising i) a nucleic acid molecule encoding a polypeptide having at least 95% sequence identity to SEQ ID NO: 2, wherein the polypeptide has insecticidal activity and ii) a silencing element targeting a sequence having at least 95% sequence identity to SEQ ID NO: 993, wherein the silencing element has insecticidal activity.

14. The composition of claim 13, wherein the silencing element comprises a double stranded RNA.

15. A method for controlling an insect pest population comprising contacting the insect pest population with the transgenic plant of claim 10.

* * * * *